United States Patent 12,569,549 (FLAVIVIRUS VACCINE) - sequence listing, part 18

SEQ ID NO: 8574 - RNA, 9879 nt, synthetic construct
  misc_feature 1..9879: note = derived and/or modified CDS sequence (opt1) from DENV-1__GQ199841__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgcgctgctgtggatggcctccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgacggtcgcggccaacgagatgggcctgctcgagaccaccaagaaggacctggggatcggccacgtggccgtggagaaccaccaccacgccgccatgctggacgtcgacctccaccccgcgtccgcctggaccctgtacgccgtggccacgaccatcatcacccccatgatgcgccacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggcgaacatcttccgggggagctacctcgccggcgccggcctggccttctccctgatgaagtccctcgggggcgggcgccggggcaccggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcacgatggcccaccgcaagccgacctacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcgcagatcatggaggtgaccgccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggcgggccgggtgctcgactggctggagaagcacggggtggagcgcctgaagcggatggccatctccggcgacgactgcgtcgtgaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagaccgcctgcctgggcaagtcctacgcccagatgtggcagctcatgtacttccaccggcgcgacctgcggctggcggccaacgccatctgcagcgccgtgccggtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcacggcgcgggccacctgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8575 - RNA, 9879 nt, synthetic construct
  misc_feature 1..9879: note = derived and/or modified CDS sequence (opt1) from DENV-1__FJ898407__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacaccacggacacctgggtgacctacgggacctgcagccagacgggcgagcaccggcgcgacaagcggagcgtggccctcgcgccccacgtcggcctggggctggagacccgggccgagacctggatgagctccgagggcgcctggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcggcctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcagaccaaggcctcccaggaggggccgctccccgagatcgaggacgaggtgttccggaagcgcaacctgacgatcatggacctgcaccccggcagcgggaagacccggcgctacctcccggccatcgtccgggaggccatcaagcgcaagctgcggaccctgatcctcgcgcccacccgcgtggtggcctccgagatggccgaggccctgaagggcatgcccatccgctaccagacgaccgccgtcaagagcgagcacaccggccgggagatcgtggacctgatgtgccacgcgaccttcacgatgcgcctcctgtcccccgtgcgggtcccgaactacaacatgatcatcatggacgaggcccacttcaccgaccccagctccatcgccgcccgcgggtacatcagcacccgggtgggcatgggggaggccgcggccatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctgcgcaagaacgggaagcgggtcatccagctctcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgccggccccatgccggtgacggtggcgtccgccgcccagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgcgctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcctccgagggcttccagtacagcgaccggcgctggtgcttcgacggcgagcggaacaaccaggtcctcgaggagaacatggacgtggagatctggacgaaggagggggagcgcaagaagctgcggccccgctggctggacgcgcggacctactccgaccccctcgccctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagacgctgatgctgctcgccctgatcgcggtgctgaccggcggggtgaccctcttcttcctgtccggccgcgggctgggcaagaccagcatcggcctcctgtgcgtcatggcctccagcgccctgctctggatggcctccgtggagccccactggatcgccgcgagcatcatcctggagttcttcctgatggtgctcctgatccccgagccggaccggcagcgcacgccccaggacaaccagctggcctacgtcgtgatcgggctcctgttcatgatcctgacggtggccgccaacgagatgggcctcctggagaccaccaagaaggacctggggatcggccacgtcgccgtggagaaccaccaccacgcgaccatgctcgacgtggacctgcaccccgcctccgcctggacgctgtacgccgtcgccaccaccatcatcaccccgatgatgcggcacacgatcgagaacaccaccgcgaacatcagcctcaccgccatcgccaaccaggccgccatcctgatggggctggacaagggctggcccatctccaagatggacatcggcgtgcccctcctggcgctggggtgctacagccaggtgaaccccctcacgctgaccgccgccgtcctgatgctcgtggcccactacgcgatcatcggcccggggctgcaggccaaggccacccgcgaggcccagaagcgcaccgccgcgggcatcatgaagaaccccacggtggacgggatcgtcgccatcgacctggaccccgtggtgtacgacgccaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgcggtcagcatggccaacatcttccgcgggagctacctggccggcgccggcctggccttctccctcatgaagtccctcgggggcgggcggcgcgggaccggggcgcagggcgagaccctgggcgagaagtggaagcggcagctcaaccagctgtccaagagcgagttcaacacgtacaagcgctccgggatcatggaggtggaccggagcgaggccaaggagggcctgcgccgcggggagaccaccaagcacgccgtgtcccgcggcaccgccaagctccggtggttcgtcgagcgcaacctggtgaagcccgaggggaaggtgatcgacctgggctgcggccgcggcgggtggagctactactgcgcggggctgaagaaggtcacggaggtgaaggggtacaccaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacgtcccgcatgctgctcaaccgcttcaccatggcccaccggaagcccacctacgagcgcgacgtcgacctgggggccggcacccggcacgtggcggtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggcagcgcctccagcatggtcaacggggtggtgaagctcctgaccaagccctgggacgtcatccccatggtgacccagatcgccatgacggacaccacccccttcggccagcagcgggtgttcaaggagaaggtcgacacccgcacgccgaaggcgaagcgggggaccgcccagatcatggaggtgaccgcccgctggctgtggggcttcctctcccggaacaagaagccccgcatctgcacccgggaggagttcacgcgcaaggtgcggagcaacgccgccatcggcgcggtcttcgtggacgagaaccagtggaactccgccaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggcgaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgcgggctgggacacccgcatcacggaggacgacctgcagaacgaggccaagatcaccgacatcatggagccggagcacgccctcctggccacctccatcttcaagctgacctaccagaacaaggtcgtgcgcgtgcagcggcccgcccgcaacgggacggtcatggacgtgatcagccggcgcgaccagcggggctccggccaggtgggcacctacggcctcaacaccttcaccaacatggaggcgcagctgatccgccagatggagagcgaggggatcttctcccccagcgagctggagacgcccaacctcgccgagcgggtcctggactggctggagaagcacggcgtggagcgcctcaagcggatggccatctccggggacgactgcgtggtcaagccgatcgacgaccgcttcgccaccgccctgagcgcgctgaacgacatgggcaaggtgcggaaggacatcccccagtgggagcccagcaaggggtggaacgactggcagcaggtccccttctgctcccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcccagatgtggcagctgatgtacttccaccggcgcgacctgcggctcgcggccaacgccatctgctccgccgtgcccgtggactgggtccccaccagccgcacgacctggtccatccacgcgcaccaccagtggatgaccaccgaggacatgctgagcgtgtggaaccgcgtgtggatcgaggagaacccctggatggaggacaagacgcacatctccagctggggcgacgtcccgtacctggggaagcgggaggaccagtggtgcggctccctcatcggcctgaccgcccgcgccacctgggccaccaacatccaggtggccatcaaccaggtgcggcgcctgatcgggaacgagaactacctcgactacatgaccagcatgaagcggttcaagaacgagtccgaccccgagggcgcgctgtggtga

SEQ ID NO: 8576 - RNA, 9879 nt, synthetic construct
  misc_feature 1..9879: note = derived and/or modified CDS sequence (opt1) from DENV-1__FJ898408__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcggcctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatcatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgggaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcacggggaacatcgtgagcgccgtgaacatgacctcccggatgctgctgaaccgcttcaccatggcccaccgcaagcccacctacgagcgggacgtcgacctcggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtcctggactggctggagaagtacggggtggagcggctcaagcgcatggccatcagcggcgacgactgcgtggtcaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgcggaccccggggactgggtgcccaccagccggaccacctggtccatccacgcccaccaccagtggatgacgaccgaggacatgctgagcgtgtggaaccgcgtctggatcgaggagaacccctggatggaggacaagacccacgtgtccagctggggcgacgtgccgtacctgggcaagcgggaggaccagtggtgcgggtccctcatcggcctgaccgcccgcgccacctgggccagcaacatccaggtcgcgatcaaccaggtgcgccggctgatcgggaacgagaactacctcgactacatgacgtccatgaagcgcttcaagaacgagggcgaccccgagggggccctgtggtga

SEQ ID NO: 8577 - RNA, 9879 nt, synthetic construct
  misc_feature 1..9879: note = derived and/or modified CDS sequence (opt1) from DENV-1__GQ199843__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggagcgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctgaagctctcctggttcaagaaggggagctccatcggcaagatgttcgaggccaccgcccgcggggcccgccggatggccatcctgggcgacaccgcgtgggacttcgggagcatcggcggcgtcttcacgtccgtggggaagctggtgcaccagatcttcggcaccgcctacggggtcctcttcagcggcgtgtcctggaccatgaagatcgggatcggcgtgctgctgacctggctcggcctgaacagccgctccacgagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgaccaacgaggtccacacgtggaccgagcagtacaagttccaggccgactccccgaagcggctgagcgcggccatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacgcaggtctgcgaccaccgcctcatgagcgccgcgatcaaggactccaaggccgtgcacgccgacatgggctactggatcgagagcgagaagaacgagacctggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggtcctgcatcatggtgggcgccaacgccagcgaccgcatggggatgggcacgacctacctcgcgctgatggccaccttcaagatgcgcccgatgttcgccgtcggcctgctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctgggcagcctcgggtgcaagccgctgaccatgttcctgatcgccgagaacaagatctggggccgcaagagctggcccctcaacgaggggatcatggcggtgggcatcgtctccatcctgctgagctccctcctgaagaacgacgtgcccctggccgggcccctcatcgccggcggcatgctgatcgcctgctacgtgatcagcgggtccagcgccgacctgtccctcgagaaggcggccgaggtcagctgggaggaggaggccgagcactccggcgccagccacaacatcctggtggaggtgcaggacgacgggacgatgaagatcaaggacgaggagcgggacgacaccctgaccatcctcctgaaggccaccctgctcgcggtctccggcgtgtacccgctgagcatccccgccaccctgttcgtgtggtacttctggcagaagaagaagcagcgctccggggtcctctgggacacgcccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgccatcgcgcaggccaaggcctcccaggaggggccgctccccgagatcgaggacgaggtgttccggaagcgcaacctgaccatcatggacctgcaccccggcagcgggaagacgcggcgctacctcccggccatcgtccgggaggcgatcaagcgcaagctgcggaccctgatcctcgcccccacccgcgtggtggcctccgagatggccgaggccctgaagggcatgcccatccgctaccagaccacggcggtcaagagcgagcacaccggccgggagatcgtggacctgatgtgccacgccaccttcaccatgcgcctcctgtcccccgtgcgggtcccgaactacaacatgatcatcatggacgaggcccacttcacggaccccagctccatcgccgcccgcgggtacatcagcacccgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgcgggccccatgccggtgaccgtggcctccgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcgtccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgccgccggccggcgcagcgtgtccggggacctgatcctcgagatcggcaagctgccgcagcacctgacccagcgggcgcagaacgccctcgacaacctggtcatgctgcacaacagcgagcagggcgggcgcgcctaccggcacgccatggaggagctccccgacaccatcgagaccctgatgctgctcgcgctgatcgccgtgctgacgggcggggtgaccctcttcttcctgtccggccgcgggctgggcaagaccagcatcggcctcctgtgcgtcatggcctccagcgccctgctctggatggcctccgtggagccccactggatcgcggccagcatcatcctggagttcttcctgatggtgctcctgatccccgagccggaccggcagcgcacgccccaggacaaccagctggcctacgtcgtgatcgggctcctgttcatgatcctgaccgtggccgccaacgagatgggcctcctggagacgaccaagaaggacctggggatcggccacgcggccgtcgagaaccaccaccacgccaccatgctcgacgtggacctgcaccccgcctccgcctggaccctgtacgcggtggccacgaccatcatcaccccgatgatgcggcacaccatcgagaacacgaccgccaacatcagcctcaccgccatcgccaaccaggcggccatcctgatggggctggacaagggctggcccatctccaagatggacatcggcgtccccctcctggccctggggtgctacagccaggtgaaccccctcaccctgacggccgcggtgctgatgctcgtcgcccactacgccatcatcggcccggggctgcaggccaaggccacccgcgaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcggaccacctgggcgctctgcgagagcatcaccctggccacgggccccctgaccaccctctgggaggggtccccgggcaagttctggaacaccacgatcgccgtgagcatggccaacatcttccgcgggagctacctggccggcgcgggcctggccttctccctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggccaaggagggcctgcgccgcggggagacgaccaagcacgcggtgtcccgcggcaccgccaagctccggtggttcgtggagcgcaacctggtcaagcccgaggggaaggtgatcgacctgggctgcggccgcggcgggtggagctactactgcgccgggctgaagaaggtgaccgaggtcaaggggtacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacctcccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcctaccacgggtcctacgaggtcaagccgagcggcagcgcgtccagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcccgctggctgtggggcttcctctcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggccaagatcacggacatcatggagccggagcacgccctcctggcgacctccatcttcaagctgacctaccagaacaaggtggtccgcgtgcagcggcccgcccgcaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagcacggcgtcgagcgcctcaagcggatggccatctccggggacgactgcgtggtgaagccgatcgacgaccgcttcgcgacggccctgagcgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggtccctgcgcgagaccgcgtgcctcggcaagagctacgcccagatgtggcagctgatgtacttccaccggcgcgacctgcggctcgccgccaacgcgatctgctccgccgtccccgtggactgggtgcccaccagccgcaccacgtggtccatccacgcccaccaccagtggatgaccaccgaggacatgctgagcgtctggaaccgcgtgtggatcgaggagaacccctggatggaggacaagacccacatctccagctggggcgacgtgccgtacctggggaagcgggaggaccagtggtgcggctccctcatcggcctgacggcccgcgccacctgggcgaccaacatccaggtcgccatcaaccaggtgcggcgcctgatcgggaacgagaactacctcgactacatgaccagcatgaagcggttcaagaacgagtccgaccccgagggcgccctgtggtga

SEQ ID NO: 8578 - RNA, 9879 nt, synthetic construct
  misc_feature 1..9879: note = derived and/or modified CDS sequence (opt1) from DENV-1__GQ199844__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccatcgcgaccatcacgccccaggcccccacgtccgagatccagctcaccgactacggggccctgaccctggactgcagcccccgcaccggcctcgacttcaacgagatggtgctgctgacgatgaaggagaagtcctggctcgtccacaagcagtggttcctggacctgccgctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccgtgggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgcgtccctgttccccctctgcctgagcaccacgtcccagaagaccacctggctgcccgtgctcctgggcagcctggggtgcaagccgctcaccatgttcctgatcacggagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgaccatcctgctcaaggcgacgctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggaccctgatcctggcccccacgcgcgtggtggcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagacgttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggcggtggagaaccaccaccacgccacgatgctggacgtcgacctccaccccgcctccgcctggaccctgtacgccgtggcgaccaccatcatcacgccgatgatgcgccacaccatcgagaacaccaccgccaacatcagcctgacggccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacccgggaggcccagaagcgcacggcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgcgaccggccccctgaccacgctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcaccggggcccagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgacggaggtgaagggctacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggacgggcaacatcgtgagcgccgtcaacatgacctcccggatgctgctgaaccgcttcaccatggcccaccgcaagcccacctacgagcgggacgtggacctcggggcgggcacgcgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgcgatgaccgacaccacccccttcggccagcagcgcgtcttcaaggagaaggtggacacgcggaccccgaaggccaagcgcgggaccgcccagatcatggaggtgaccgcccggtggctgtggggcttcctgtcccgcaacaagaagccccggatctgcacgcgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgcgaagaacgggaccgtgatggacgtgatcagccgccgggaccagcgcggctccgggcaggtcggcacctacggcctgaacaccttcacgaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcgcagatgtggcagctgatgtacttccaccgccgggacctgcgcctcgccgccaacgccatctgctccgcggtgcccgtcgactgggtgcccaccagccggaccacctggtccatccacgcccaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacgtccatgaagcgcttcaagaacgagggcgaccccgagggggccctgtggtga

SEQ ID NO: 8579 - RNA, 9879 nt, synthetic construct
  misc_feature 1..9879: note = derived and/or modified CDS sequence (opt1) from DENV-1__GQ199845__SS-prME
  source 1..9879: mol_type = other RNA
agcgtgaccatgctgctgatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcatgttcacgtccgtggggaagctggtccaccagatcttcggcaccgcctacggggtgctgttcagcggcgtgtcctggaccatgaagatcgggatcggcgtcctcctgacctggctgggcctcaacagccgctccacgagcctgtccatgacctgcatcgccgtggggctggtgaccctctacctgggcgtcatggtgcaggccgacagcgggtgcgtgatcaactggaagggccgggagctgaagtgcgggagcggcatcttcgtcaccaacgaggtgcacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagctgaccgtcgtggtgggggacgtcgcgggcatcctcgcccaggggaagaagatgatccggccccagcccatggagtacaagtactcctggaagatctggggcaaggccaagatcatcggcgccgacgtgcagaacaccacgttcatcatcgacgggcccaacaccccggagtgccccgacgaccagcgcgcgtggaacatctgggaggtggaggactacggcttcgggatcttcaccaccaacatctggctgaagctgcgggacagctacacgcaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcttcctgctcatcatggggcagctgacctggaacgacctgatccggctctgcatcatggtgggcgcgaacgccagcgaccgcatggggatgggcacgacctacctggccctgatggccaccttcaagatgcgcccgatgttcgccgtcggcctcctgttccggcgcctgacctcccgggaggtgctcctgctgacgatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcaccttcatccgcacgaccttctccctgcactacgcctggaagaccatggcgatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggacgatgaagatcaaggacgaggagcgcgacgacaccctgaccatcctcctgaaggccaccctgctcgccgtctccggcgtgtacccgctgagcatccccgccaccctgttcgtgtggtacttctggcagaagaagaagcagcggtccggggtcctctgggacacgcccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagacggcccccgggaccttcaagaccagcgagggcgaggtgggcgccatcgcgctggacttcaagcccgggacctccggcagccccatcgtcaaccgggaggggaagatcgtgggcctgtacggcaacggggtggtcacgaccagcggcacctacgtgtccgccatcgcccaggccaaggcgagccaggaggggcccctcccggagatcgaggacgaggtgttccgcaagcggaacctgaccatcatggacctgcaccccggctccgggaagacgcgccggtacctccccgccatcgtccgcgaggccaccaagcggcgcctgcgcaccctgatcctcgccccgacccgggtggtggccagcgagatggcggaggccctgaagggcatgcccatccgctaccagacgaccgccgtcaagtccgagcacaccggcaaggagatcgtggacctgatgtgccacgccaccttcacgatgcggctcctgagccccgtgcgcgtccccaactacaacatgatcatcatggacgaggcccacttcaccgacccgtccagcatcgcggcccgggggtacatctccacccgcgtgggcatgggggaggccgccgccatcttcatgaccgcgacgccgcccggcagcgtggaggccttcccccagtccaacgccgtcatccaggacgaggagcgggacatcccggagcgcagctggaactccgggtacgagtggatcaccgacttccccggcaagaccgtgtggttcgtgcccagcatcaagtccggcaacgacatcgccaactgcctgcggaagaacgggaagcgcgtcatccagctcagccggaagaccttcgacacggagtaccagaagaccaagaacaacgactgggactacgtggtgaccaccgacatctccgagatgggcgcgaacttccgcgccgaccgggtcatcgacccccgccggtgcctgaagccggtgatcctgaaggacgggcccgagcgcgtgatcctcgccggccccatgcccgtcacggtggccagcgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccggctgcgcggcgaggcccggaagaccttcgtcgagctcatgcgccgcggggacctgccggtgtggctgagctacaaggtggccagcgagggcttccagtactccgaccgccggtggtgcttcgacggcgagcgcaacaaccaggtcctcgaggagaacatggacgtggagatctggacgaaggagggggagcggaagaagctgcgcccccggtggctggacgcccgcacctacagcgaccccctcgccctgcgggagttcaaggagttcgcggccggccgccggtccgtgagcggggacctgatcctcgagatcggcaagctgccccagcacctgacccagcgcgcccagaacgccctcgacaacctggtcatgctgcacaactccgagcagggcgggcgggcgtaccgccacgccatggaggagctcccggacaccatcgagacgctgatgctgctcgccctgatcgccgtgctgaccggcggggtgaccctcttcttcctgagcggccgggggctgggcaagacctccatcggcctcctgtgcgtcatggccagctccgtgctgctctggatggcgagcgtggagccccactggatcgccgcctccatcatcctggagttcttcctgatggtcctcctgatccccgagcccgaccgccagcggaccccgcaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccgccatgctcgacgtcgacctgcaccccgccagcgcgtggaccctgtacgccgtggccacgaccatcatcacccccatgatgcgccacaccatcgagaacacgaccgccaacatctccctcaccgccatcgcgaaccaggccgccatcctgatggggctggacaagggctggccgatcagcaagatggacatcggcgtgcccctcctggccctggggtgctactcccaggtcaaccccctcaccctgacggcggccgtgctgatgctcgtggcccactacgccatcatcggccccgggctgcaggccaaggcgacccgcgaggcccagaagcggaccgccgccggcatcatgaagaacccgaccgtcgacgggatcgtggccatcgacctggaccccgtggtctacgacgcgaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgccgtgtccatggccaacatcttccgggggagctacctggcgggcgccggcctggccttcagcctcatgaagtccctcgggggcgggcgccgggggaccggggcccagggcgagaccctgggcgagaagtggaagcgccagctcaaccagctgagcaagtccgagttcaacacctacaagcggagcgggatcatggaggtggaccgctccgaggcgaaggagggcctgaagcgcggggagacgaccaagcacgccgtcagccgcggcaccgccaagctccggtggttcgtggagcgcaacctggtgaagccggaggggaaggtcatcgacctgggctgcggccgcggcgggtggtcctactactgcgccgggctgaagaaggtgaccgaggtgaaggggtacacgaagggcggccccggccacgaggagcccatccccatggccacctacgggtggaacctcgtcaagctgcacagcggcaaggacgtgttcttcatcccgcccgagaagtgcgacaccctgctctgcgacatcggggagtccagccccaaccccaccatcgaggagggccgcacgctgcgggtgctgaagatggtcgagccgtggctccgcgggaaccagttctgcatcaagatcctgaacccctacatgccctccgtggtggagaccctggagcagatgcagcggaagcacggcggcatgctcgtccgcaaccccctgagccggaactccacccacgagatgtactgggtgagctgcgggaccggcaacatcgtgtccgcggtcaacatgaccagccgcatgctgctcaaccgcttcacgatggcccaccggaagccgacctacgagcgcgacgtggacctgggggccggcacccggcacgtggccgtcgagcccgaggtggccaacctggacatcatcggccagcgcatcgagaacatcaagcacgagcacaagtccacctggcactacgacgaggacaacccctacaagacgtgggcgtaccacgggagctacgaggtgaagccctccggcagcgccagctccatggtcaacggggtggtcaagctcctgaccaagccgtgggacgtgatccccatggtgacccagatcgccatgaccgacacgacccccttcggccagcagcgggtcttcaaggagaaggtggacacccgcacccccaaggccaagcgggggacggcccagatcatggaggtgaccgcgaagtggctgtggggcttcctcagccgcaacaagaagccgcggatctgcacccgcgaggagttcacccggaaggtccgctccaacgccgccatcggcgccgtgttcgtggacgagaaccagtggaacagcgcgaaggaggccgtcgaggacgagcggttctgggacctggtgcaccgcgagcgggagctgcacaagcaggggaagtgcgccacgtgcgtgtacaacatgatgggcaagcgcgagaagaagctcggggagttcggcaaggccaaggggtcccgggccatctggtacatgtggctgggcgcgcgcttcctggagttcgaggccctcggcttcatgaacgaggaccactggttcagccgggagaactccctgagcggggtcgagggcgaggggctgcacaagctcggctacatcctgcgcgacatctccaagatccccgggggcaacatgtacgccgacgacaccgccggctgggacacccggatcaccgaggacgacctgcagaacgaggccaagatcacggacatcatggagcccgagcacgcgctcctggccaagagcatcttcaagctgacctaccagaacaaggtggtgcgcgtccagcgcccggccaagaacgggaccgtgatggacgtgatctcccggcgcgaccagcggggcagcgggcaggtcggcacctacggcctcaacacgttcaccaacatggaggcccagctgatccgccagatggagtccgaggggatcttcagcccctccgagctggagacccccaacctcgccggccgggtgctggactggctggagaagcacggggtggagcgcctcaagcggatggcgatcagcggcgacgactgcgtcgtgaagcccatcgacgaccgcttcgccaccgccctgacggccctgaacgacatggggaaggtgcggaaggacatcccgcagtgggagccctccaagggctggaacgactggcagcaggtccccttctgcagccaccacttccaccagctcatcatgaaggacggccgcgagatcgtggtgccctgccggaaccaggacgagctggtcgggcgcgcccgggtgagccagggcgcggggtggtccctgcgcgagaccgcctgcctcggcaagagctacgcccagatgtggcagctgatgtacttccaccggcgcgacctgcggctcgccgcgaacgccatctgctccgccgtgccggtcgactgggtgcccaccagccgcaccacgtggtccatccacgcccaccaccagtggatgaccaccgaggacatgctgagcgtgtggaaccgggtctggatcgaggagaacccctggatggaggacaagacccacgtgtccagctggggcgacgtgccctacctgggcaagcgcgaggaccagtggtgcggctccctcatcgggctgacggcccgcgcgacctgggccaccaacatccaggtcgccatcaaccaggtgcggcgcctgctcggcaacgagaactacctggactacatgaccagcatgaagcggttcaagaacgagtccgacccggagggggccctgtggtga

SEQ ID NO: 8580 - RNA, 9879 nt, synthetic construct
  misc_feature 1..9879: note = derived and/or modified CDS sequence (opt1) from DENV-1__GQ199846__SS-prME
  source 1..9879: mol_type = other RNA
agcgtgaccatgctgctcatgctgatgcccaccgccctggccttccacctcacgacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgggacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccatcatggcccgggacaagcccaccctggacatcgagctcctgaagacggaggtcaccaaccccgcggtgctgcgcaagctctgcatcgaggccaagatcagcaacaccaccacggactcccggtgccccacccagggcgaggccaccctgatggaggagcaggacgccaacttcgtgtgccgccggaccttcgtcgaccgcggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacaccggcgaccagcaccaggtcgggaacgagagcacggagcacggcaccaccgcgaccatcacgccccaggcccccacgtccgagatccagctcaccgactacggggccctgaccctggactgcagcccccggaccggcctcgacttcaacgagatggtgctgctgacgatgaaggagaagtcctggctcgtccacaagcagtggttcctggacctgccgctcccctggaccagcggggccagcacctcccaggagacctggaaccgccaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccggctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccgcctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccgcatggcgatcctgggcgacaccgcctgggacttcgggtccgtgggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccggagcacgtccctgagcatgacctgcatcgccgtggggctcgtcaccctgtacctgggcgtgatggtgcaggccgactccgggtgcgtcatcaactggaagggccgcgagctcaagtgcgggagcggcatcttcgtgaccaacgaggtgcacacgtggaccgagcagtacaagttccaggcggacagcccgaagcggctgtccgccgccatcggcaaggcctgggaggagggggtctgcggcatccgcagcgccacccggctggagaacatcatgtggaagcagatctccaacgagctcaaccacatcctgctggagaacgacatgaagttcaccgtggtggtcggggacgtggtgggcatcctcgcgcaggggaagaagatgatccgcccccagcccatggagcacaagtacagctggaagtcctggggcaaggccaagatcatcggcgccgacgtccagaacaccacgttcatcatcgacgggcccaacaccccggagtgccccgacgaccagcgggcctggaacatctgggaggtggaggactacggcttcgggatcttcaccaccaacatctggctgaagctgcgcgacagctacacccaggtgtgcgaccaccggctcatgtccgcggccatcaaggacagcaaggccgtccacgccgacatgggctactggatcgagtccgagaagaacgagacctggaagctggcccgcgcgagcttcatcgaggtgaagacctgcatctggcccaagtcccacaccctgtggagcaacggcgtgctcgagtccgagatgatcatccccaagatctacgggggcccgatcagccagcacaactaccggcccgggtacttcacgcagaccgccggcccctggcacctggggaagctggagctcgacttcgacctgtgcgagggcaccaccgtcgtggtggacgagcactgcggcaaccgcgggccgtccctgcggacgaccaccgtcaccggcaagatcatccacgagtggtgctgccgcagctgcacgctgccgcccctccggttcaagggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcaccctggccgtcttcctgctcctgatcatggggcagctgacctggaacgacctcatccgcctgtgcatcatggtgggcgccaacgcgagcgaccgcatggggatgggcacgacctacctggccctcatggccaccttcaagatgcggccgatgttcgccgtgggcctgctgttccgccggctcacctcccgcgaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgcgtccctgttccccctctgcctgagcaccacgtcccagaagaccacctggctgcccgtgctcctgggcagcctggggtgcaagccgctcaccatgttcctgatcacggagaccaagatctggggccggaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgcgacgacaccctgaccatcctgctcaaggcgacgctgctggccgtctccggcgtgtacccgctcagcatccccgccaccctgttcgtgtggtacttctggcagaagaagaagcagcggtccggggtcctgtgggacacccccagcccgcccgaggtggagcgcgccgtgctggacgacggcatctaccggatcatgcagcgcggcctcctggggcggtcccaggtcggcgtgggggtgttccaggagaacgtcttccacaccatgtggcacgtgacgcgcggcgccgtgctgatgtaccaggggaagcggctcgagcccagctgggcgtccgtcaagaaggacctgatcagctacggcggcgggtggcgcctgcagggctcctggaacaccggggaggaggtccaggtgatcgccgtcgagcccggcaagaaccccaagaacgtgcagaccgcccccgggaccttcaagacgcccgagggcgaggtgggcgccatcgccctcgacttcaagcccgggaccagcggctcccccatcgtcaaccgggaggggaagatcgtgggcctgtacggcaacggggtggtcaccaccagcggcacgtacgtgagcgcgatcgcccaggccaaggcctcccaggaggggccgctgcccgagatcgaggacgaggtgttccgcaagcggaacctcaccatcatggacctgcaccccggcagcgggaagacccgccggtacctgccggcgatcgtccgcgaggccatcaagcggaagctccgcaccctgatcctggcccccacgcgcgtggtggcctccgagatggccgaggcgctcaagggcatgcccatccggtaccagaccaccgccgtcaagagcgagcacaccggcaaggagatcgtggacctgatgtgccacgccacgttcaccatgcgcctgctctcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctgtcccgcaagacgttcgacaccgagtaccagaagaccaagaacaacgactgggactacgtggtgaccacggacatcagcgagatgggcgccaacttccgggcggaccgcgtcatcgacccgcggcgctgcctcaagcccgtgatcctgaaggacgggcccgagcgggtcatcctggccggccccatgccggtgaccgtggcctccgccgcccagcgccgggggcgcatcggccggaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccgcctgcggggcgaggcgcgcaagacgttcgtcgagctgatgcggcgcggggacctccccgtgtggctgtcctacaaggtggccagcgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacctactccgaccccctggccctccgcgagttcaaggagttcgccgcgggccggcgcagcgtgtccggggacctgatcctggagatcggcaagctcccgcagcacctgacccagcgggcccagaacgccctggacaacctcgtcatgctgcacaacagcgagcagggcgggcgcgcctaccggcacgcgatggaggagctgcccgacacgatcgagaccctcatgctgctggccctcatcgccgtgctgaccggcggggtgaccctgttcttcctctccggccgcgggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccggcagcgcacgccccaggacaaccagctggcctacgtggtgatcgggctcctcttcatgatcctgaccgtcgccgccaacgagatgggcctgctcgagaccaccaagaaggacctggggatcggccacgtggcggtggagaaccaccaccacgccacgatgctggacgtcgacctccaccccgcctccgcctggaccctgtacgccgtggcgaccaccatcatcacgccgatgatgcggcacaccatcgagaacaccaccgccaacatcagcctgacggccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacccgcgaggcccagaagcgcacggcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcggaccacgtgggccctgtgcgagagcatcaccctcgcgaccggccccctgaccacgctgtgggaggggtccccgggcaagttctggaacaccaccatcgccgtgagcatggccaacatcttccgcgggtcctacctcgccggcgccggcctggcgttcagcctgatgaagtccctcgggggcgggcggcgcggcaccggggcccagggcgagacgctgggcgagaagtggaagcggcagctgaaccagctctccaagagcgagttcaacatctacaagcgctccgggatcatggaggtggaccggagcgaggccaaggagggcctgaagcgcggggagaccacccggcacgccgtctcccgcggcaccgcgaagctgcggtggttcgtggagcgcaacctggtgaagcccgaggggaaggtcatcgacctcggctgcggccgcggcgggtggagctactactgcgccgggctgaagaaggtgacggaggtgaaggggtacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggacgggcaacatcgtgagcgccgtcaacatgacctcccgcatgctgctgaaccgcttcaccatggcccaccggaagcccacctacgagcgcgacgtggacctcggggcgggcacgcggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgcgatgaccgacaccacccccttcggccagcagcgggtcttcaaggagaaggtggacacgcgcaccccgaaggccaagcgggggaccgcccagatcatggaggtgaccgcccgctggctgtggggcttcctgtcccggaacaagaagccccgcatctgcacgcgggaggagttcacccgcaaggtccggagcaacgccgcgatcggcgccgtgttcgtggacgagaaccagtggaactccgccaaggaggccgtcgaggacgagcgcttctgggacctcgtgcagaaggagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacaccgccggctgggacacgcggatcaccgaggacgacctgcagaacgaggccaagatcaccgacatcatggagccggagcacgccctgctcgccacctccatcttcaagctgacgtaccagaacaaggtggtgcgcgtccagcgccccgcgaagaacgggaccgtgatggacgtgatcagccggcgcgaccagcggggctccgggcaggtcggcacctacggcctgaacaccttcacgaacatggaggcccagctcatccgccagatggagagcgaggggatcttcctgccctccgagctggagacccccaacctcgccgagcgggtgctggactggctggagaagtacggcgtggagcgcctcaagcggatggccatcagcggggacgactgcgtcgtgaagccgatcgacgaccgcttcgccaccgcgctgaccgccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcccgggtgtcccagggggccggctggagcctgcgcgagacggcctgcctcggcaagagctacgcgcagatgtggcagctgatgtacttccaccggcgcgacctgcggctcgccgccaacgccatctgctccgcggtgcccgtcgactgggtgcccaccagccgcaccacctggtccatccacgcccaccaccagtggatgacgaccgaggacatgctgagcgtgtggaaccgggtctggatcgaggagaacccctggatggaggacaagacccacgtgtccagctggggcgacgtgccgtacctggggaagcgcgaggaccagtggtgcggctccctcatcggcctgaccgcccgcgccacctgggccagcaacatccaggtcgcgatcaaccaggtgcggcgcctgatcgggaacgagaactacctcgactacatgacgtccatgaagcggttcaagaacgagggcgaccccgagggggccctgtggtga

SEQ ID NO: 8581 - RNA, 9879 nt, synthetic construct
  misc_feature 1..9879: note = derived and/or modified CDS sequence (opt1) from DENV-1__GQ199847__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgacccggacgactgggtccccaccagccgcaccacctggtccatccacgcccaccaccagtggatgacgaccgaggacatgctcagcgtgtggaaccgggtgtggatcgaggagaacccctggatggaggacaagacccacatctccagctggggcgacgtcccctacctgggcaagcgcgaggaccagtggtgcggctccctgatcgggctcaccgcgcgggccacgtgggccaccaacatccaggtggccatcaaccaggtgcgccgcctgatcggcaacgagaactacctggactacatgaccagcatgaagcggttcaagaacgagtccgacccggagggggccctctggtga

SEQ ID NO: 8582 - RNA, 9879 nt, synthetic construct
  misc_feature 1..9879: note = derived and/or modified CDS sequence (opt1) from DENV-1__GQ199849__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccggacgggcgagcaccgccgggacaagcgcagcgtggccctcgcgccccacgtgggcctggggctggagacccggaccgagacctggatgtccagcgagggcgcctggaagcagatccagcgcgtggagacgtgggccctccggcaccccgggttcaccgtgatcgccctgttcctggcgcacgccatcggcacctccatcacccagaaggggatcatcttcatcctcctgatgctggtgacgcccagcatggccatgcgctgcgtcggcatcggctcccgggacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcgcaagctctgcatcgaggccaagatcagcaacaccacgaccgactcccggtgccccacccagggcgaggccaccctgatggaggagcaggacgccaacttcgtgtgccgccggacgttcgtcgaccgcggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccggacgggcctcgacttcaacgagatggtgctgctgaccatgaaggagaagtcctggctcgtccacaagcagtggttcctggacctgccgctcccctggaccagcggggccagcacctcccaggagacgtggaaccgccaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccggctcaagatggacaagctggcgctgaagggcatgagctacgtgatgtgcaccgggtccttcaagctcgagaaggaggtcgccgagacccagcacggcacggtgctggtgcagatcaagtacgagggcaccgacgccccctgcaagatccccttcagcacccaggacgagaagggggtcacccagaacggccgcctgatcacggccaacccgatcgtgaccgacaaggagaagcccgtgaacatcgaggcggagccgcccttcggggagtcctacatcgtcatcggcgccggcgagaaggccctgaagctcagctggttcaagaaggggtccagcatcggcaagatgttcgaggccaccgcccgcggggcccgccgcatggccatcctgggcgacaccgcctgggacttcgggtccatcggcggcgtgttcacgagcgtggggaagctggtccaccagatcttcggcaccgcctacggggtcctgttctccggcgtgagctggaccatgaagatcgggatcggcgtcctgctgacctggctcggcctgaactcccggagcacgtccctgagcatgacctgcatcgccgtggggctcgtgaccctgtacctgggcgtcatggtgcaggcggactccgggtgcgtgatcaactggaagggccgcgagctcaagtgcgggagcggcatcttcgtcaccaacgaggtgcacacgtggaccgagcagtacaagttccaggccgacagcccgaagcggctgtccgccgccatcggcaaggcctgggaggagggggtgtgcggcatccgcagcgcgacccggctggagaacatcatgtggaagcagatctccaacgagctcaaccacatcctgctggagaacgggctcaagttcaccgtcgtggtgggcgacgtcgtggggatcctggcccagggcaagaagatgatccgcccccagcccatggagcacaagtacagctggaagtcctggggcaaggccaagatcatcggggccgacgtgcagaacaccacgttcatcatcgacggccccaacaccccggagtgccccgacgaccagcgggcgtggaacatctgggaggtcgaggactacgggttcggcatcttcaccaccaacatctggctgaagctccgcgacagctacacccaggtgtgcgaccaccggctgatgtccgccgccatcaaggacagcaaggccgtgcacgccgacatgggctactggatcgagtccgagcgcaacgagacctggaagctggcgcgggccagcttcatcgaggtcaagacctgcatctggcccaagtcccacaccctctggagcaacggggtgctggagtccgagatgatcatccccaagatctacggcgggccgatcagccagcacaactaccgccccggctacttcacgcagaccgccgggccctggcacctgggcaagctcgagctggacttcgacctgtgcgagggcaccaccgtggtcgtggacgagcactgcgggaaccggggcccgtccctccgcacgaccaccgtgaccgggaagatcatccacgagtggtgctgccggagctgcacgctgccgcccctgcgcttcaagggcgaggacgggtgctggtacggcatggagatccggcccgtcaaggagaaggaggagaacctcgtgaagtccatggtgagcgccggcagcggggaggtcgactccttcagcctgggcctgctctgcacctccatcatgatcgaggaggtgatgcgcagccggtggtcccgcaagatgctgatgaccgggaccctggccgtgttcctcctgctgatcatgggccagctcacgtggaacgacctgatccgcctgtgcatcatggtcggggcgaacgccagcgaccggatgggcatgggcaccacctacctcgccctgatggccaccttcaagatgcgcccgatgttcgccgtggggctcctgttccggcgcctgacgtcccgggaggtgctgctcctgaccatcgggctgagcctcgtcgcgtccgtggagctgcccaacagcctggaggagctcggggacggcctggccatgggcatcatgatcctgaagctcctgaccgacttccagtcccaccagctgtgggccaccctcctgagcctgacgttcatcaagaccaccctctccctgcactacgcctggaagaccatggcgatggtcctgagcatcgtgtccctcttccccctgtgcctgagcacgacctcccagaagaccacctggctccccgtgctgctggggagcctcggctgcaagccgctgacgatgttcctgatcgccgagaacaagatctgggggcgcaagtcctggcccctcaacgagggcatcatggccgtcggggtggtgagcatcctgctgagctccctcctgaagaacgacgtccccctggccggccccctcatcgccggcgggatgctgatcgcgtgctacgtgatcagcggctccagcgccgacctgtccctcgagaaggccgccgaggtgagctgggaggaggaggccgagcactccggggcgagccacaacatcttcgtcgaggtgcaggacgacggcaccatgaagatcaaggacgaggagcgggacgacaccctgaccatcctgctcaaggccaccctgctggccgtgtccggggtctacccgctcagcatccccgccacgctgttcgtgtggtacttctggcagaagaagaagcagcgctccggcgtgctgtgggacacccccagcccgcccgaggtcgagcgggccgcgctggacgacggcatctaccgcatcatgcagcgggggctcctgggccgctcccaggtgggggtgggcgtcttccaggagaacgtgttccacaccatgtggcacgtgacccgcggggccgtcctgatgtaccagggcaagcgcctcgagcccagctgggcctccgtgaagaaggacctgatcagctacggcgggggctggcggctgcaggggtcctggaacacgggcgaggaggtgcaggtcatcgccgtggagcccgggaagaaccccaagaacgtgcagaccgcccccggcaccttcaagacccccgagggcgaggtcggggcgatcgccctcgacttcaagcccggcacgagcgggtcccccatcgtgaaccgcgagggcaagatcgtgggcctgtacgggaacggcgtcgtgaccaccagcgggacctacgtgagcgccatcgcccagacgaaggcgtcccaggagggcccgctgcccgagatcgaggacgaggtcttccggaagcgcaacctcaccatcatggacctgcaccccgggagcggcaagacccggcgctacctgccggccatcgtgcgggaggccatcaagcgcaagctccgcaccctgatcctggcccccacgcgggtggtcgcctccgagatggcggaggccctcaagggcatgcccatccgctaccagaccaccgccgtcaagagcgagcacaccgggaaggagatcgtggacctgatgtgccacgccacgttcaccatgcggctgctctcccccgtccgcgtgccgaactacaacatgatcatcatggacgaggcccacttcaccgaccccagctccatcgcggcccggggctacatcagcacccgcgtggggatgggcgaggccgccgccatcttcatgacggcgacgccgcccgggtccgtcgaggccttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctgtcccggaagacgttcgacaccgagtaccagaagaccaagaacaacgactgggactacgtggtcaccacggacatcagcgagatgggggcgaacttccgcgccgaccgggtgatcgacccgcgccggtgcctcaagcccgtgatcctgaaggacggccccgagcgcgtcatcctggccgggcccatgccggtgaccgtcgcctccgccgcgcagcggcgcggccggatcggccgcaaccacaacaaggagggggaccagtacatctacatgggccagcccctcaacaacgacgaggaccacgcccactggaccgaggccaagatgctgctggacaacatcaacacccccgaggggatcatccccgccctcttcgagccggagcgcgagaagtccgccgcgatcgacggcgagtaccggctgcgcggggaggcccggaagacgttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgcggccgggcgccggagcgtctccggcgacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacacgatcgagaccctcatgctgctggccctcatcgccgtgctgaccgggggcgtcaccctgttcttcctctccgggcggggcctgggcaagaccagcatcgggctgctctgcgtgatggcctccagcgtgctgctgtggatggcgtccgtcgagccccactggatcgccgccagcatcatcctcgagttcttcctgatggtgctgctcatccccgagccggaccgccagcggacgccccaggacaaccagctggcctacgtggtcatcggcctcctcttcatcatcctgaccgtggccgcgaacgagatggggctgctcgagaccaccaagaaggacctgggcatcgggcacgtggccgtcgagaaccaccaccacgccacgatgctggacgtggacctccaccccgcctccgcctggaccctgtacgcggtggccaccaccatcatcacgccgatgatgcgccacaccatcgagaacaccaccgccaacatcagcctgacggccatcgccaaccaggcggccatcctcatgggcctggacaagggctggcccatctccaagatggacatcggggtccccctgctcgccctgggctgctacagccaggtgaaccccctgaccctcaccgccgcggtgctgatgctggtcgcccactacgccatcatcgggccgggcctccaggccaaggccacccgcgaggcgcagaagcggacggccgccgggatcatgaagaaccccaccgtggacggcatcgtggccatcgacctggaccccgtcgtgtacgacgccaagttcgagaagcagctgggccagatcatgctcctgatcctgtgcacctcccagatcctcctgatgcgcaccacgtgggcgctgtgcgagagcatcaccctcgccaccgggcccctgaccacgctgtgggagggctccccggggaagttctggaacaccaccatcgccgtgagcatggccaacatcttccggggctcctacctcgccggcgcggggctggccttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtcgaccgcagcgaggccaaggaggggctgaagcggggcgagaccacccgccacgcggtgtcccgggggaccgccaagctgcgctggttcgtggagcggaacctggtcaagcccgagggcaaggtgatcgacctcggctgcgggcgcggcgggtggagctactactgcgccggcctgaagaaggtgacggaggtcaaggggtacaccaagggcggccccgggcacgaggagcccatcccgatggccacctacggctggaacctggtgaagctccactccgggaaggacgtgttcttcacgccgcccgagaagtgcgacacgctgctgtgcgacatcggcgagagctcccccaacccgaccatcgaggaggggcggaccctccgcgtcctgaagatggtggagccctggctgcggggcaaccagttctgcatcaagatcctcaacccctacatgcccagcgtggtcgagaccctggagcagatgcagcgcaagcacggcgggatgctggtgcggaacccgctctcccgcaacagcacccacgagatgtactgggtgtcctgcggcacggggaacatcgtcagcgccgtgaacatgacctcccgcatgctgctgaaccggttcaccatggcgcaccgcaagcccacctacgagcgggacgtggacctcggcgccggcacgcgccacgtcgccgtggagcccgaggtggccaacctggacatcatcgggcagcggatcgagaacatcaagcacgagcacaagagcacctggcactacgacgaggacaacccctacaagacctgggcctaccacggctcctacgaggtcaagccgagcgggtccgcgagcagcatggtgaacggcgtcgtgaagctgctcaccaagccctgggacgtgatccccatggtcacgcagatcgccatgaccgacaccacccccttcgggcagcagcgcgtgttcaaggagaaggtggacacgcggaccccgaaggccaagcgcggcaccgcccagatcatggaggtcaccgcccggtggctgtggggcttcctgtcccgcaacaagaagccccggatctgcacgcgcgaggagttcacccggaaggtgcgcagcaacgcggccatcggggccgtgttcgtcgacgagaaccagtggaactccgccaaggaggcggtggaggacgagcggttctgggacctcgtgcagaaggagcgcgagctgcacaagcagggcaagtgcgcgacctgcgtctacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtggagggggagggcctgcacaagctggggtacatcctccgggacatcagcaagatccccggcggcaacatgtacgccgacgacaccgccgggtgggacacgcgcatcaccgaggacgacctgcagaacgaggccaagatcaccgacatcatggagccggagcacgccctgctcgcgacctccatcttcaagctgacgtaccagaacaaggtggtccgcgtgcagcggcccgccaagaacggcaccgtgatggacgtcatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtgctggactggctggagaagtacggggtcgagcggctcaagcgcatggccatcagcggcgacgactgcgtggtgaagccgatcgacgaccggttcgcgaccgccctgaccgccctgaacgacatggggaaggtccgcaaggacatcccccagtgggagccctccaagggctggaacgactggcagcaggtccccttctgcagccaccacttccaccagctcatcatgaaggacggccgggagatcgtggtcccgtgccgcaaccaggacgagctggtggggcgggcccgcgtgtcccagggcgccgggtggagcctgcgggagacggcgtgcctcggcaagagctacgcccagatgtggcagctgatgtacttccaccgccgggacctgcgcctcgccgccaacgcgatctgctccgccgtccccgtggactgggtgcccaccagccggaccacctggtccatccacgcccaccaccagtggatgacgaccgaggacatgctgagcgtctggaaccgcgtgtggatcgaggagaacccctggatggaggacaagacccacgtgtccagctggggcgacgtcccgtacctgggcaagcgcgaggaccagtggtgcggctccctcatcgggctgaccgcccgggccacctgggcgagcaacatccaggtggccatcaaccaggtgcgccggctgatcggcaacgagaactacctcgactacatgacgtccatgaagcgcttcaagaacgagggggaccccgagggcgccctgtggtga

SEQ ID NO: 8583 - RNA, 9879 nt, synthetic construct
  misc_feature 1..9879: note = derived and/or modified CDS sequence (opt1) from DENV-1__FJ898410__SS-prME
  source 1..9879: mol_type = other RNA
agcgtgaccatgctgctgatgctgacccccaccgccctggccttccacctcaccacccggggcggggagccccacatgatcgtgtccaagcaggagcggggcaagagcctgctgttcaagacctccgcgggggtgaacatgtgcacgctcatcgccatggacctgggcgagttctgcgaggacaccatgacctacaagtgcccccgcatcaccgaggccgagcccgacgacgtggactgctggtgcaacgccacggacacctgggtcacctacgggacctgcagccagacgggcgagcaccggcgggacaagcggtccgtggccctggcgccccacgtgggcctcgggctggagacccgcaccgagacctggatgagctccgagggcgcctggaagcagatccagcgggtcgagacgtgggccctgcgccaccccgggttcaccgtgatcgccctcttcctggcgcacgccatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgcggtgctgcggaagctgtgcatcgaggccaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgcccctgccctggaccagcggggcctccaccagccaggagacgtggaaccggcaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagatctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcttcctgctcatcatggggcagctgacgtggaacgacctgatccggctctgcatcatggtcggcgcgaacgccagcgaccgcatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatccgcaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagaccagcgagggcgaggtcggcgccatcgcgctggacttcaagcccgggacgtccggcagccccatcgtgaaccgggaggggaagatcgtgggcctgtacggcaacggggtcgtgaccaccagcggcacctacgtgtccgccatcgcccaggccaaggcgagccaggaggggcccctcccggagatcgaggacgaggtcttccgcaagcggaacctgacgatcatggacctgcaccccggctccgggaagacccgccggtacctccccgccatcgtgcgcgaggccatcaagcggcgcctgcgcaccctgatcctcgccccgacccgggtggtcgccagcgagatggcggaggccctgaagggcatgcccatccgctaccagacgaccgccgtgaagtccgagcacaccggcaaggagatcgtggacctgatgtgccacgccaccttcacgatgcggctcctgagccccgtccgcgtgcccaactacaacatgatcatcatggacgaggcccacttcaccgacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctcagccggaagaccttcgacacggagtaccagaagaccaagaacaacgactgggactacgtggtcaccaccgacatctccgagatgggcgcgaacttccgcgccgaccgggtgatcgacccccgccggtgcctgaagccggtgatcctgaaggacgggcccgagcgcgtcatcctcgccggccccatgcccgtgacggtcgccagcgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgccagcgagggcttccagtactccgaccgccggtggtgcttcgacggcgagcgcaacaaccaggtgctcgaggagaacatggacgtggagatctggacgaaggagggggagcggaagaagctgcgcccccggtggctggacgcccgcacctacagcgaccccctcgccctgcgggagttcaaggagttcgcggccggccgccggtccgtcagcggggacctgatcctcgagatcggcaagctgccccagcacctgacccagcgcgcccagaacgccctcgacaacctggtgatgctgcacaactccgagcagggcgggcgggcgtaccgccacgccatggaggagctcccggacaccatcgagacgctgatgctgctcgccctgatcgccgtgctgaccggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgccagcgcgtggaccctgtacgccgtggccacgaccatcatcacccccatgatgcgccacaccatcgagaacacgaccgccaacatctccctcaccgccatcgcgaaccaggccgccatcctgatggggctggacaagggctggccgatcagcaagatggacatcggcgtccccctcctggccctggggtgctactcccaggtgaaccccctcaccctgacggcggccgtgctgatgctcgtcgcccactacgccatcatcggccccgggctgcaggccaaggcgacccgcgaggcccagaagcggaccgccgccggcatcatgaagaacccgaccgtggacgggatcgtggccatcgacctggaccccgtcgtgtacgacgcgaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgccgtgtccatggccaacatcttccgggggagctacctggcgggcgccggcctggccttcagcctcatgaagtccctcgggggcgggcgccgggggaccggggcccagggcgagaccctgggcgagaagtggaagcgccagctcaaccagctgagcaagccggagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagcccgaggggaaggtgatcgacctgggctgcggccgcggcgggtggagctactactgcgccgggctgaagaaggtgaccgaggtcaaggggtacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccgcttcacgatggcccaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgaagtggctgtggggcttcctctcccgcaacaagaagccccggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagccggagcacgcgctcctggccaagtccatcttcaagctgacctaccagaacaaggtggtccgcgtgcagcgccccgccaagaacgggaccgtgatggacgtcatcagccggcgcgaccagcggggctccggccaggtgggcacctacggcctcaacacgttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagccgatcgacgaccgcttcgccaccgccctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgcggggtggagcctgcgcgagaccgcctgcctcggcaagtcctacgcccagatgtggcagctgatgtacttccaccggcgcgacctgcggctcgccgcgaacgccatctgcagcgccgtccccgtggactgggtgcccacctcccgcaccacgtggagcatccacgcccaccaccagtggatgaccaccgaggacatgctgtccgtctggaaccgggtgtggatcgaggagaacccctggatggaggacaagacccacgtgagctcctggggcgacgtcccgtacctgggcaagcgcgaggaccagtggtgcggcagcctcatcgggctgacggcccgcgcgacctgggccaccaacatccaggtggccatcaaccaggtgcggcgcctgctcggcaacgagaactacctggactacatgacctccatgaagcggttcaagaacgagagcgaccccgagggggccctgtggtga

SEQ ID NO: 8584 - RNA, 9879 nt, synthetic construct
  misc_feature 1..9879: note = derived and/or modified CDS sequence (opt1) from DENV-1__FJ898411__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtcgccatcaaccaggtgcgccgcctgatcggcaacgagaactacctggactacatgaccagcatgaagcggttcaagaacgagtccgacccggagggggccctctggtga

SEQ ID NO: 8585 - RNA, 9879 nt, synthetic construct
  misc_feature 1..9879: note = derived and/or modified CDS sequence (opt1) from DENV-1__FJ898412__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgtgaccatgctggacgtcgacctccaccccgcctccgcctggacgctgtacgccgtggccaccaccatcatcaccccgatgatgcgccacacgatcgagaacaccaccgcgaacatcagcctgaccgccatcgccaaccaggccgccatcctcatggggctggacaagggctggcccatctccaagatggacatcggcgtgcccctgctcgcgctggggtgctacagccaggtcaaccccctgacgctcaccgccgccgtgctgatgctggtggcccactacgcgatcatcggcccggggctccaggccaaggccacccgggaggcccagaagcgcaccgccgcgggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtccccgggcaagttctggaacacgaccatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggccggcacccgccacgtggcggtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgccatgacggacaccacccccttcggccagcagcgcgtcttcaaggagaaggtggacacccggacgccgaaggcgaagcgcgggaccgcccagatcatggaggtgaccgcccggtggctgtggggcttcctgtcccgcaacaagaagccccggatctgcacccgcgaggagttcacgcggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgccaagaacgggacggtgatggacgtgatcagccgccgggaccagcgcggctccgggcaggtcggcacctacggcctgaacaccttcaccaacatggaggcgcagctcatccggcagatggagagcgaggggatcttcctgccctccgagctggagacgcccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtgcccgtcgactgggtgcccacgagccggaccacctggtccatccacgcgcaccaccagtggatgaccacggaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacctccatgaagcgcttcaagaacgagggcgaccccgagggggcgctgtggtga

SEQ ID NO: 8586 - RNA, 9879 nt, synthetic construct
  misc_feature 1..9879: note = derived and/or modified CDS sequence (opt1) from DENV-1__GQ199852__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcaccaccggcacgctggccgtcttcctgctcctgatcatggggcagctgacctggaacgacctcatccggctgtgcatcatggtgggcgccaacgcgagcgaccgcatggggatgggcaccacctacctggccctcatggccacgttcaagatgcgcccgatgttcgccgtgggcctgctgttccggcgcctcacctcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccctgcccctccactgcgcctggaagacgatggccatggtgctgtccatcgcgagcctgttccccctctgcctgtccaccaccagccagaagaccacgtggctgccggtgctcctgggctccctggggtgcaagcccctcaccatgttcctgatcaccgagaccaagatctggggccgcaagagctggcccctgaacgaggggatcatggccgtcggcgtggtgtccatcctcctgagcagcctgctcaagaacgacgtccccctggccgggccgctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgtggtgcaggacgacgggaccatgaagatcaaggacgaggagcgggacgacacgctgaccatcctgctcaaggcgaccctgctggccgtcagcggcgtgtaccccctctccatccccgccaccctgttcgtgtggtacttctggcagaagaagaagcagcgcagcggggtcctgtgggacacgccctccccgcccgaggtggagcgggccgtgctggacgacggcatctaccgcatcatgcagcggggcctcctggggcgcagccaggtcggcgtgggggtgttccaggagaacgtcttccacaccatgtggcacgtgacccggggcgccgtgctgatgtaccaggggaagcgcctcgagccctcctgggcgagcgtcaagaaggacctgatctcctacggcggcgggtggcggctgcagggcagctggaacaccggggaggaggtccaggtgatcgccgtcgagcccggcaagaacccgaagaacgtgcagacggcccccgggaccttcaagacccccgagggcgaggtgggcgccatcgccctcgacttcaagcccgggacctccggcagcccgatcgtcaaccgcgaggggaagatcgtgggcctgtacggcaacggggtggtcacgacctccggcacctacgtgagcgcgatcgcccaggccaaggccagccaggaggggcccctgcccgagatcgaggacgaggtgttccggaagcgcaacctcaccatcatggacctgcacccgggctccgggaagacgcggcgctacctgcccgcgatcgtccgggaggccatcaagcgcaagctccggaccctgatcctggcccccacccgcgtggtggccagcgagatggccgaggcgctcaagggcatgcccatccgctaccagaccacggccgtcaagtccgagcacaccggcaaggagatcgtggacctgatgtgccacgccaccttcaccatgcggctgctcagcccggtgcgcgtccccaactacaacatgatcatcatggacgaggcccacttcacggacccctccagcatcgccgcgcgggggtacatctccacccgcgtgggcatgggggaggccgccgccatcttcatgaccgccacgccgcccggcagcgtggaggcgttcccccagtccaacgccgtcatccaggacgaggagcgggacatccccgagcgcagctggaactccgggtacgagtggatcacggacttccccggcaagaccgtgtggttcgtgcccagcatcaagtccggcaacgacatcgccaactgcctgcggaagaacgggaagcgcgtcatccagctgagccggaagaccttcgacaccgagtaccagaagacgaagaacaacgactgggactacgtggtgaccaccgacatctccgagatgggcgccaacttccgcgcggaccgggtcatcgacccccgccggtgcctcaagcccgtgatcctgaaggacgggcccgagcgcgtcatcctggccggcccgatgcccgtgaccgtggccagcgccgcccagcggcgcgggcggatcggccgcaaccacaacaaggagggcgaccagtacatctacatggggcagcccctcaacaacgacgaggaccacgcgcactggacggaggccaagatgctgctggacaacatcaacacccccgagggcatcatcccggccctcttcgagcccgagcgggagaagtccgccgccatcgacggggagtaccgcctgcgcggcgaggcgcggaagaccttcgtcgagctgatgcgccgcggggacctccccgtgtggctgagctacaaggtggcctccgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtacagcgacccgctggccctccgggagttcaaggagttcgccgcgggccgccggtccgtgagcggggacctgatcctggagatcggcaagctcccccagcacctgacccagcgcgcccagaacgccctggacaacctcgtcatgctgcacaactccgagcagggcgggcgggcctaccgccacgcgatggaggagctgcccgacaccatcgagaccctcatgctgctggccctcatcgccgtgctgaccggcggggtgacgctgttcttcctcagcggccgggggctgggcaagacctccatcggcctgctctgcgtcatggccagctccgtgctgctgtggatggccagcgtggagccccactggatcgcggcctccatcatcctcgagttcttcctgatggtcctgctcatcccggagcccgaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccacccggccagcgcctggaccctgtacgccgtggcgacgaccatcatcacccccatgatgcgccacaccatcgagaacacgaccgccaacatctccctgaccgccatcgccaaccaggccgcgatcctcatggggctggacaagggctggcccatcagcaagatggacatcggcgtgcccctgctcgccctggggtgctactcccaggtcaacccgctgaccctcacggccgccgtgctgatgctggtggcgcactacgccatcatcggccccgggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgagccagatcctcctgatgcgcaccacctgggccctgtgcgagtccatcaccctcgcgacgggcccgctgaccaccctgtgggaggggagccccggcaagttctggaacaccacgatcgccgtgtccatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagaccacgcgccacgccgtcagccggggcaccgcgaagctgcgctggttcgtggagcggaacctggtgaagcccgaggggaaggtcatcgacctcggctgcggccgcgggggctggtcctactactgcgccgggctgaagaaggtgaccgaggtgaagggctacaccaagggcgggcccggccacgaggagccgatccccatggccacgtacgggtggaacctggtcaagctccacagcggcaaggacgtgttcttcacgccgcccgagaagtgcgacaccctgctgtgcgacatcggggagtccagcccgaaccccaccatcgaggagggccggaccctccgcgtgctgaagatggtcgagccctggctgcgggggaaccagttctgcatcaagatcctcaacccctacatgccgtccgtggtggagacgctggagcagatgcagcgcaagcacggcggcatgctggtccggaaccccctcagccgcaactccacccacgagatgtactgggtgagctgcgggaccggcaacatcgtgtccgccgtcaacatgaccagccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagtccacctggcactacgacgaggacaacccgtacaagacgtgggcctaccacgggagctacgaggtcaagccctccggcagcgcctccagcatggtgaacggggtggtcaagctgctcaccaagccctgggacgtgatccccatggtgacccagatcgcgatgaccgacacgaccccgttcggccagcagcgcgtcttcaaggagaaggtggacacccggacccccaaggccaagcgcgggacggcccagatcatggaggtgaccgcccggtggctgtggggcttcctgagccgcaacaagaagccccggatctgcacccgcgaggagttcacccggaaggtccgctccaacgccgcgatcggcgccgtgttcgtggacgagaaccagtggaacagcgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccggcgggaacatgtacgcggacgacaccgccgggtgggacacccgcatcaccgaggacgacctgcagaacgaggccaagatcacggacatcatggagcccgagcacgccctgctcgccaccagcatcttcaagctgacctaccagaacaaggtggtgcgggtccagcgccccgcgaagaacgggaccgtgatggacgtgatctcccgccgggaccagcgcggcagcgggcaggtcggcacgtacggcctgaacaccttcaccaacatggaggcccagctcatccggcagatggagtccgaggggatcttcctgcccagcgagctggagaccccgaacctcgccgagcgcgtgctggactggctggagaagtacggcgtggagcggctcaagcgcatggccatctccggggacgactgcgtcgtgaagcccatcgacgaccggttcgccacggcgctgaccgccctgaacgacatgggcaaggtgcgcaaggacatcccccagtgggagcccagcaaggggtggaacgactggcagcaggtcccgttctgctcccaccacttccaccagctcatcatgaaggacggccgggagatcgtggtgccctgccgcaaccaggacgagctggtcggccgggcccgcgtgagccagggggccggctggtccctgcgggagaccgcctgcctcggcaagagctacgcgcagatgtggcagctgatgtacttccaccgccgggacctgcgcctcgccgccaacgccatctgcagcgcggtgcccgtcgactgggtgcccacctcccggacgacctggagcatccacgcccaccaccagtggatgaccaccgaggacatgctgtccgtgtggaaccgcgtctggatcgaggagaacccgtggatggaggacaagacccacgtgagctcctggggcgacgtgccctacctggggaagcgggaggaccagtggtgcggcagcctcatcggcctgacggcccgcgccacctgggcctccaacatccaggtcgcgatcaaccaggtgcgccggctgatcgggaacgagaactacctcgactacatgaccagcatgaagcgcttcaagaacgagggcgaccccgagggggccctgtggtga

SEQ ID NO: 8587 - RNA, 9879 nt, synthetic construct
  misc_feature 1..9879: note = derived and/or modified CDS sequence (opt1) from DENV-1__FJ898415__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcctgacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctcaagctgtcctggttcaagaaggggagcaacatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggactccccgaagcgcctgagcgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgtgggcatcctggcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctccgggacagctacacccaggtgtgcgaccaccgcctgatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtcgtggacgagcactgcggcaaccgggggccgtccctccgcaccaccaccgtgacgggcaagaccatccacgagtggtgctgccggagctgcaccctgccgcccctgcgcttcaagggggaggacggctgctggtacgggatggagatccggcccgtcaaggagaaggaggagaacctcgtgaagtccatggtgagcgccggctccggcgaggtcgacagcttcagcctggggctgctctgcatctccatcatgatcgaggaggtgatgcgcagccggtggtcccgcaagatgctgatgaccggcacgctggccgtgttcctcctgctgatcatggggcagctcacctggaacgacctgatccggctgtgcatcatggtcggcgccaacgcgagcgaccgcatggggatgggcaccacctacctcgccctgatggccacgttcaagatgcgcccgatgttcgccgtggggctgctgttccggcgcctgacctcccgggaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccacgctcctgagcctgaccttcatcaagaccaccctctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgcaagtcctggcccctcaacgaggggatcatggccgtcggcgtggtgagcatcctgctgtccagcctcctgaagaacgacgtccccctggccgggcccctcatcgccggcggcatgctgatcgcctgctacgtgatcagcgggtccagcgcggacctgtccctcgagaaggccgccgaggtgagctgggaggaggaggccgagcactccggcgccagccacaacatcctggtcgaggtgcaggacgacgggaccatgaagatcaaggacgaggagcgggacgacaccctgaccatcctcctgaaggcgacgctgctcgccgtgtccggcgtctacccgctgagcatccccgccaccctgttcgtgtggtacttctggcagaagaagaagcagcgctccggggtgctgtgggacacccccagcccgcccgaggtcgagcgggccgtgctcgacgacggcatctaccgcatcatgcagcggggcctgctggggcgctcccaggtgggcgtcggggtgttccaggagaacgtgttccacaccatgtggcacgtcacgcggggcgccgtgctcatgtaccaggggaagcgcctggagcccagctgggcgtccgtgaagaaggacctgatcagctacggcggcgggtggcggctccagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctgtacggcaacggggtggtgaccaccagcggcacgtacgtctccgcgatcgcccaggccaaggccagccaggaggggccgctccccgagatcgaggacgaggtgttccggaagcgcaacctgaccatcatggacctgcaccccggcagcgggaagacccggcgctacctcccggcgatcgtgcgggaggccatcaagcgcaagctgcggaccctgatcctcgcccccacgcgcgtcgtggcctccgagatggccgaggcgctgaagggcatgcccatccgctaccagaccaccgccgtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcgcggcgaggcgcggaagacgttcgtggagctcatgcgccgcggggacctgcccgtctggctgtcctacaaggtggccagcgagggcttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacctacagcgaccccctcgccctgcgggagttcaaggagttcgccgcgggccgccggagcgtgtccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccaccaagaaggacctggggatcggccacgtcgcggtggagaaccaccaccacgccacgatgctcgacgtggacctgcaccccgcctccgcctggaccctgtacgccgtcgcgaccaccatcatcacgccgatgatgcgccacaccatcgagaacaccaccgccaacatcagcctcacggccatcgccaaccaggccgcgatcctgatggggctggacaagggctggcccatctccaagatggacatcggcgtgcccctcctggccctggggtgctacagccaggtgaaccccctcaccctgaccgccgccgtcctgatgctcgtggcgcactacgccatcatcggcccggggctgcaggccaaggccacccgggaggcccagaagcgcacggcggccggcatcatgaagaaccccaccgtggacgggatcgtcgccatcgacctggaccccgtggtgtacgacgccaagttcgagaagcagctcggccagatcatgctgctgatcctctgcacctcccagatcctgctgatgcgcaccacgtgggccctctgcgagagcatcaccctggcgaccggccccctgaccacgctctgggaggggtccccgggcaagttctggaacaccaccatcgccgtcagcatggccaacatcttccgggggtcctacctggccggcgccggcctggcgttcagcctcatgaagtccctcgggggcgggcgccgggggaccggggcccagggcgagacgctgggcgagaagtggaagcgccagctcaaccagctgagcaagagcgagttcaacatctacaagcggtccgggatcatggaggtggaccgcagcgaggccaaggagggcctgaagcgcggggagaccacccgccacgccgtgtcccggggcaccgcgaagctgcgctggttcgtcgagcggaacctcgtgaagcccgaggggaaggtgatcgacctgggctgcggccgcgggggctggagctactactgcgccgggctgaagaaggtcacggaggtgaagggctacaccaagggcgggcccggccacgaggagcccatcccgatggccacctacgggtggaacctcgtgaagctgcactccggcaaggacgtcttcttcacgccgcccgagaagtgcgacacgctgctctgcgacatcggggagagctcccccaacccgaccatcgaggagggccggaccctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggacgggcaacatcgtgagcgccgtgaacatgacctcccggatgctgctcaaccgcttcaccatggcccaccgcaagcccacctacgagcgggacgtcgacctgggggcgggcacgcgccacgtggccgtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagctccatggtcaacggggtggtgaagctcctgaccaagccctgggacgtcatccccatggtgacgcagatcgcgatgaccgacaccacccccttcggccagcagcgcgtgttcaaggagaaggtcgacacgcggaccccgaaggccaagcgcgggaccgcccagatcatggaggtgaccgcccggtggctgtggggcttcctcagccgcaacaagaagccccggatctgcacgcgcgaggagttcacccggaaggtgcgcagcaacgccgcgatcggcgccgtcttcgtggacgagaaccagtggaactccgccaaggaggccgtggaggacgagcggttctgggacctggtccagaaggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgcggacgacaccgccggctgggacacgcgcatcaccgaggacgacctgcagaacgaggccaagatcaccgacatcatggagccggagcacgccctcctggccacctccatcttcaagctgacgtaccagaacaaggtcgtgcgggtgcagcgccccgcgaagaacgggaccgtcatggacgtgatcagccgccgggaccagcgcggctccggccaggtgggcacctacggcctcaacaccttcacgaacatggaggcccagctgatccggcagatggagagcgaggggatcttctcccccagcgagctggagatccccaacctcgccgagcgcgtcctggactggctggagaagtacggcgtggagcggctcaagcgcatggccatctccggggacgactgcgtggtcaagccgatcgacgaccggttcgccaccgcgctgaccgccctgaacgacatgggcaaggtgcgcaaggacgtgccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggtccctgcgggagaccgcctgcctcggcaagagctacgcgcagatgtggcagctgatgtacttccaccgccgggacctgcgcctcgccgccaacgccatctgcagcgcggtgcccgtcgactgggtgcccacgtcccggaccacctggagcatccacgcccaccaccagtggatgaccacggaggacatgctgtccgtgtggaaccgcgtctggatcgaggagaacccctggatggaggacaagacccacgtgagctcctggggcgacgtgccgtacctggggaagcgggaggaccagtggtgcggcagcctcatcggcctgaccgcccgcgccacctgggcctccaacatccaggtcgcgatcaaccaggtgcgccggctgatcgggaacgagaactacctcgactacatgaccagcatgaagcgcttcaagaacgagggcgaccccgagggggccctgtggtga

SEQ ID NO: 8588 - RNA, 9879 nt, synthetic construct
  misc_feature 1..9879: note = derived and/or modified CDS sequence (opt1) from DENV-1__FJ898416__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgacgatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaagacctcccaggaggggccgctgcccgagatcgaggacgaggtgttccggaagcgcaacctcaccatcatggacctgcaccccggcagcgggaagacgcggcgctacctgccggccatcgtccgggaggcgatcaagcgcaagctccggaccctgatcctggcccccacccgcgtggtggcctccgagatggccgaggccctcaagggcatgcccatccgctaccagaccacggcggtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggacggaggcgaagatgctgctggacaacatcaacacccccgagggcatcatccccgccctcttcgagccggagcgggagaagtccgccgccatcgacggggagtaccgcctgcgcggcgaggcccggaagaccttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacaccatcgagaccctcatgctgctggcgctcatcgccgtgctgaccggcggggtgacgctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggccgtggagaaccaccaccacgcgaccatgctggacgtcgacctccaccccgcctccgcctggaccctgtacgccgtggccacgaccatcatcaccccgatgatgcgccacaccatcgagaacacgaccgcgaacatcagcctgaccgccatcgccaaccaggccgccatcctcatggggctggacaagggctggcccatctccaagatggacatcggcgtgcccctgctcgcgctggggtgctacagccaggtcaaccccctgaccctcacggccgccgtgctgatgctggtggcccactacgcgatcatcggcccggggctccaggccaaggccacccgggaggcccagaagcgcaccgccgcgggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtccccgggcaagttctggaacaccacgatcgcggtgagcatggccaacatcttccgggggtcctacctcgccggcgccggcctggccttcagcctgatgaagtccctcgggggcgggcgccggggcaccggggcgcagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagacgctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggccggcacccgccacgtggcggtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgccatgaccgacacgacccccttcggccagcagcgcgtcttcaaggagaaggtggacacccggaccccgaaggcgaagcgcgggacggcccagatcatggaggtgaccgcccggtggctgtggggcttcctgtcccgcaacaagaagccccggatctgcacccgcgaggagttcacccggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgccacgtgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgccaagaacgggaccgtgatggacgtgatcagccgccgggaccagcgcggctccgggcaggtcggcacgtacggcctgaacaccttcaccaacatggaggcgcagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccacggccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcccagatgtggcagctgatgtacttccaccgccgggacctgcgcctcgcggccaacgccatctgctccgccgtgcccgtcgactgggtgcccaccagccggacgacctggtccatccacgcgcaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgacggcccgcgccacctgggccagcaacatccaggtcgccatcaaccaggtgcgccggctgatcgggaacgagaactacctcgactacatgacctccatgaagcgcttcaagaacgagggcgaccccgagggggtgctgtggtga

SEQ ID NO: 8589 - RNA, 9879 nt, synthetic construct
  misc_feature 1..9879: note = derived and/or modified CDS sequence (opt1) from DENV-1__FJ898417__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgacccggtcgactgggtgcccaccagccgcaccacctggtccatccacgcccaccaccagtggatgacgaccgaggacatgctcagcgtgtggaaccgggtctggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtggccatcaaccaggtccgccgcctgatcggcaacgagaactacctggactacatgaccagcatgaagcggttcaagaacgagtccgacccggagggggccctctggtga

SEQ ID NO: 8590 - RNA, 9879 nt, synthetic construct
  misc_feature 1..9879: note = derived and/or modified CDS sequence (opt1) from DENV-1__GQ868612__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgccatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcctcatcgaggtgaagacctgcatctggcccaagtcccacacgctgtggagcaacggggtgctggagtccgagatgatcatccccaagatctacggcgggccgatcagccagcacaactaccgccccggctacttcacccagaccgccgggccctggcacctcggcaagctggagctggacttcgacctctgcgagggcaccacggtcgtggtggacgagcactgcgggaaccggggcccgtccctgcgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctggtgaagtccatggtcagcgccggcagcggggaggtggactccttcagcctgggcctcctgtgcatctccatcatgatcgaggaggtgatgcggagccgctggtcccggaagatgctgatgaccgggaccctcgcggtcttcttcctgctgatcatgggccagctcacgtggaacgacctgatccgcctgtgcatcatggtgggggccaacgccagcgaccgcatgggcatgggcaccacctacctcgccctgatggccaccttcaagatgcggccgatgttcgcggtggggctcctcttccgccggctgacgtcccgcgaggtcctgctcctgaccatcggcctgagcctcgtggcctccgtggagctgcccaacagcctggaggagctcggggacggcctggccatgggcatcatgatcctgaagctcctgaccgacttccagtcccaccagctgtgggccaccctcctgagcctgacgttcatcaagaccaccttctccctccactacgcgtggaagaccatggccatggtcctgagcatcgtgtccctgttccccctctgcctgagcacgacctcccagaagaccacctggctgcccgtcctcctggggagcctgggctgcaagccgctcacgatgttcctgatcgccgagaacaagatctgggggcggaagtcctggcccctgaacgagggcatcatggccgtggggatcgtgagcatcctcctgagctccctgctcaagaacgacgtccccctggccggccccctgatcgcgggcgggatgctcatcgcctgctacgtgatcagcggctccagcgccgacctgtccctggagaaggccgccgaggtgagctgggaggaggaggcggagcactccggggccagccacaacatcctcgtcgaggtgcaggacgacggcaccatgaagatcaaggacgaggagcgcgacgacaccctgaccatcctgctcaaggccaccctgctggccgtgtccggggtctacccgctcagcatccccgccacgctgttcgtgtggtacttctggcagaagaagaagcagcggtccggcgtgctgtgggacacccccagcccgcccgaggtcgagcgcgcggtgctggacgacggcatctaccggatcatgcagcgcgggctcctgggccggtcccaggtgggggtcggcgtgttccaggagaacgtgttccacaccatgtggcacgtcacccgcggggccgtgctgatgtaccagggcaagcggctcgagcccagctgggcctccgtgaagaaggacctgatcagctacggcgggggctggcgcctgcgggggtcctggaacacgggcgaggaggtccaggtgatcgccgtggagcccgggaagaaccccaagaacgtccagaccgcccccggcaccttcaagacccccgagggcgaggtgggggcgatcgccctcgacttcaagcccggcacgagcgggtcccccatcgtgaaccgcgagggcaagatcgtcggcctgtacgggaacggcgtggtgaccaccagcgggacctacgtcagcgccatcgcccaggcgaaggcctcccaggagggcccgctgcccgagatcgaggacgaggtgttccggaagcgcaacctcacgatcatggacctgcaccccgggagcggcaagacccggcgctacctgccggccatcgtgcgggaggccatcaagcgcaagctccgcaccctgatcctggcccccacccgggtcgtggcgtccgagatggccgaggccctcaagggcatgcccatccgctaccagacgaccgccgtcaagagcgagcacaccgggaaggagatcgtcgacctgatgtgccacgccaccttcacgatgcggctgctctcccccgtgcgcgtgccgaactacaacatgatcatcatggacgaggcgcacttcaccgaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgcgaactgcctgcggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccgcgccggtgcctcaagcccgtcatcctgaaggacggccccgagcgcgtgatcctggccgggcccatgccggtgacggtcgcctccgcggcccagcggcgcggccggatcggccgcaaccacaacaaggagggggaccagtacatctacatgggccagcccctcaacaacgacgaggaccacgcccactggaccgaggccaagatgctgctggacaacatcaacacccccgaggggatcatccccgccctcttcgagccggagcgcgagaagtccgcggccgtggacggcgagtaccggctgcgcggggaggcccggaagaccttcgtcgagctgatgcgccggggcgacctccccgtgtggctgtcctacaaggtggccagcgagggcttccagtacagcgaccgccggtggtgcttcgacggggagcgcaacaaccaggtcctggaggagaacatggacgtggagatctggacgaaggagggcgagcggaagaagctccgcccccggtggctggacgcccgcacctactccgaccccctggcgctccgggagttcaaggagttcgccgccgggcgccggagcgtgtccggcgacctgatcctggagatcggcaagctcccgcagcacctgacccagcgcgcccagaacgcgctggacaacctcgtcatgctgcacaacagcgagcagggcgggcgggcctaccgccacgccatggaggagctgcccgacaccatcgagacgctcatgctgctggccctcatcgccgtgctgaccgggggcgtgaccctgttcttcctctccgggcggggcctgggcaagaccagcatcgggctgctctgcgtcatggcgtccagcgtgctgctgtggatggcctccgtggagccccactggatcgccgccagcatcatcctcgagttcttcctgatggtcctgctcatccccgagccggaccgccagcggacgccccaggacaaccagctggcctacgtggtgatcggcctcctcttcatgatcctgacggtcgcggccaacgagatggggctgctcgagaccaccaagaaggacctgggcatcgggcacgtggccgtggagaaccaccaccacgccgccatgctggacgtcgacctccaccccgcgtccgcctggaccctgtacgccgtggccacgaccatcatcaccccgatgatgcgccacaccatcgagaacacgaccgccaacatcagcctgaccgcgatcgccaaccaggccgccatcctcatgggcctggacaagggctggcccatctccaagatggacatcggggtgcccctgctcgcgctgggctgctacagccaggtcaaccccctgaccctcacggccgccgtgctgatgctggtggcccactacgccatcatcgggccgggcctccaggcgaaggccacccgcgaggcccagaagcggaccgccgccgggatcatgaagaaccccaccgtcgacggcatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtgagcatggcgaacatcttccggggctcctacctcgccggcgccgggctggccttcagcctgatgaagtccctcggcgggggccgccgggggaccggcgcgcagggcgagaccctgggggagaagtggaagcgccagctgaaccagctctccaagagcgagttcaacacctacaagcggtccggcatcatggaggtggaccgcagcgaggccaaggaggggctgaagcggggcgagacgaccaagcacgccgtctcccgcgggaccgccaagctgcggtggttcgtggagcgcaacctggtgaagcccgagggcaaggtcatcgacctcggctgcgggcggggcgggtggagctactactgcgccggcctgaagaaggtgaccgaggtgaaggggtacacgaagggcggccccgggcacgaggagcccatcccgatggcgacctacggctggaacctggtcaagctccactccgggaaggacgtgttcttcatcccgcccgagaagtgcgacaccctgctgtgcgacatcggcgagagctcccccaacccgaccatcgaggaggggcgcacgctccgggtgctgaagatggtcgagccctggctgcgcggcaaccagttctgcatcaagatcctcaacccctacatgcccagcgtggtggagaccctggagcagatgcagcggaagcacggcgggatgctggtccgcaacccgctctcccggaacagcacccacgagatgtactgggtgtcctgcggcaccgggaacatcgtgagcgccgtcaacatgacctcccgcatgctgctgaaccgcttcacgatggcccaccggaagcccacctacgagcgcgacgtggacctcggcaccggcacccggcacgtggccgtcgagcccgaggtggccaacctggacatcatcgggcagcgcatcgagaacatcaagcacgagcacaagagcacgtggcactacgacgaggacaacccctacaagacctgggcgtaccacggctcctacgaggtgaagccgagcgggtccgccagcagcatggtcaacggcgtggtcaagctgctcaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcgcgctggctgtggggcttcctgtcccggaacaagaagccccgcatctgcacccgggaggagttcacgcgcaaggtccggagcaacgccgccatcggggccgtgttcgtggacgagaaccagtggaactccgcgaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcgcggttcctggagttcgaggccctggggttcatgaacgaggaccactggttctcccgcgagaacagcctctccggcgtcgagggggagggcctgcacaagctggggtacatcctccgggacatcagcaagatccccggcggcaacatgtacgccgacgacaccgccgggtgggacacccgcatcacggaggacgacctgcagaacgaggccaagatcaccgacatcatggagccggagcacgcgctgctcgccaaggccatcttcaagctgacctaccagaacaaggtggtgcgcgtccagcggcccgccaagaacggcaccgtgatggacgtgatctcccgccgggaccagcgcgggagcggccaggtcggcacgtacgggctgaacaccttcaccaacatggaggcccagctcatccggcagatggagtccgagggcatcttcagcccctccgagctggagacccccaacctggcggagcgcgccctcgactggctggagaagtacggggtggagcggctgaagcgcatggccatcagcggcgacgactgcgtggtcaagccgatcgacgaccggttcgccacggccctcaccgcgctgaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctcgtggggcgggcccgcgtctcccagggcgccgggtggagcctgcgggagaccgcctgcctgggcaagagctacgcgcagatgtggcagctcatgtacttccaccgccgggacctgcgcctggccgccaacgccatctgctccgccgtgcccgtggactgggtccccaccagccggacgacctggtccatccacgcgcaccaccagtggatgaccaccgaggacatgctcagcgtgtggaaccgcgtgtggatcgaggagaacccctggatggaggacaagacgcacatctccagctgggaggacgtcccgtacctggggaagcgcgaggaccagtggtgcggctccctgatcggcctcaccgcccgggccacctgggccaccaacatccaggtggccatcaaccaggtgcgccggctgatcgggaacgagaactacctggactacatgaccagcatgaagcgcttcaagaacgagtccgaccccgagggcgcgctctggtga

SEQ ID NO: 8591 - RNA, 9879 nt, synthetic construct
  misc_feature 1..9879: note = derived and/or modified CDS sequence (opt1) from DENV-1__FJ898419__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcgggtggaccctgttcttcctcagcggccgggggctgggcaagacctccatcggcctgctctgcgtcatggcgagctccgtgctgctgtggatggccagcgtggagccccactggatcgccgcctccatcatcctcgagttcttcctgatggtcctgctcatccccgagcccgaccgccagcggaccccgcaggacaaccagctggcctacgtggtgatcgggctcctcttcatgatcctgaccgtcgcggccaacgagatgggcctgctcgagacgaccaagaaggacctggggatcggccacgtggccgtggagaaccaccaccacgccgccatgctggacgtcgacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtgcccctgctcgcgctggggtgctactcccaggtcaaccccctgaccctcaccgccgccgtgctgatgctggtggcccactacgccatcatcggccccgggctccaggcgaaggccacgcgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtggaccgctccgaggccaaggagggcctgaagcgcggggagaccacgaagcacgccgtcagccgcggcaccgccaagctgcggtggttcgtggagcgcaacctcgtgaagccggaggggaaggtcatcgacctgggctgcggccgcggcgggtggtcctactactgcgccgggctgaagaaggtgaccgaggtgaaggggtacaccaagggcgggcccggccacgaggagcccatccccatggcgacgtacgggtggaacctggtcaagctccacagcggcaaggacgtgttcttcatcccgcccgagaagtgcgacaccctgctgtgcgacatcggggagtccagccccaaccccaccatcgaggagggccgcaccctccgggtgctgaagatggtcgagccgtggctgcgcgggaaccagttctgcatcaagatcctcaacccctacatgccctccgtggtggagacgctggagcagatgcagcggaagcacggcggcatgctggtccgcaaccccctcagccggaactccacccacgagatgtactgggtgagctgcgggaccggcaacatcgtgtccgccgtcaacatgaccagccgcatgctgctgaaccggttcaccatggcccaccgcaagccgacgtacgagcgcgacgtggacctcggggccggcacccggcacgtggccgtcgagcccgaggtggcgaacctggacatcatcggccagcgcatcgagaacatcaagcacgagcacaagtccacctggcactacgacgaggacaacccctacaagacctgggcctaccacgggagctacgaggtgaagccctccggcagcgccagctccatggtcaacggggtggtcaagctgctcacgaagccgtgggacgtgatccccatggtgacccagatcgccatgaccgacaccacgcccttcggccagcagcgggtcttcaaggagaaggtggacacccgcacccccaaggccaagcgggggaccgcgcagatcatggaggtgacggccaagtggctgtggggcttcctgagccgcaacaagaagccgcggatctgcacccgcgaggagttcacccggaaggtccgctccaacgccgccatcggcgcggtgttcgtggacgagaaccagtggaacagcgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtcgagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtgcgcgtccagcggccggccaagaacgggaccgtgatggacgtgatctcccgccgcgaccagcggggcagcgggcaggtcggcacctacggcctgaacaccttcacgaacatggaggcccagctcatccgccagatggagtccgaggggatcttcagcccctccgagctggagacccccaacctggcgggccgggtgctcgactggctggagaagcacggggtggagcgcctgaagcggatggccatcagcggcgacgactgcgtcgtgaagcccatcgacgaccgcttcgccaccgccctcaccgccctgaacgacatggggaaggtgcggaaggacatcccgcagtgggagccctccaagggctggaacgactggcagcaggtccccttctgcagccaccacttccaccagctgatcatgaaggacggccgcgagatcgtggtgccctgccggaaccaggacgagctcgtcgggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtgccggtcgactgggtgcccaccagccgcaccacctggtccatccacgcccaccaccagtggatgacgaccgaggacatgctcagcgtgtggaaccgggtctggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtggccatcaaccaggtccgccgcctgatcggcaacgagaactacctggactacatgaccagcatgaagcggttcaagaacgagtccgacccggagggggccctctggtga

SEQ ID NO: 8592 - RNA, 9879 nt, synthetic construct
  misc_feature 1..9879: note = derived and/or modified CDS sequence (opt1) from DENV-1__FJ898420__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgccatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggccggctcgagctggacttcgacctgtgcgagggcaccacggtcgtggtggacgagcactgcgggaaccgcggcccgtccctccggaccaccaccgtcacggggaagatcatccacgagtggtgctgccgcagctgcaccctgccgcccctgcggttccgcggcgaggacgggtgctggtacggcatggagatccggcccgtgaaggagaaggaggagaacctcgtgaagtccatggtcagcgccggcagcggggaggtggactccttcagcctgggcctgctctgcatctccatcatgatcgaggaggtgatgcgcagccggtggtcccgcaagatgctgatgaccgggaccctggcggtcttcttcctcctgatcatgggccagctgacgtggaacgacctcatccgcctgtgcatcatggtgggggccaacgccagcgaccggatgggcatgggcaccacctacctggccctcatggccaccttcaagatgcgcccgatgttcgcggtggggctgctgttccggcgcctcacgtcccgggaggtcctgctgctcaccatcggcctgagcctggtggcctccgtggagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcgtggaagaccatggccatggtcctcagcatcgtgtccctgttccccctgtgcctcagcacgacctcccagaagaccacctggctgcccgtcctgctcgggagcctgggctgcaagccgctgacgatgttcctcatcgccgagaacaagatctgggggcgcaagtcctggcccctgaacgagggcatcatggccgtggggatcgtgagcatcctgctcagctccctgctgaagaacgacgtccccctcgccggccccctgatcgcgggcgggatgctgatcgcctgctacgtgatcagcggctccagcgccgacctctccctggagaaggccgccgaggtgagctgggaggaggaggcggagcactccggggccagccacaacatcctggtcgaggtgcaggacgacggcaccatgaagatcaaggacgaggagcgggacgacaccctcaccatcctgctgaaggccaccctcctggccgtgtccggggtctacccgctgagcatccccgccaccctcttcgtgtggtacttctggcagaagaagaagcagcgctccggcgtgctgtgggacacccccagcccgcccgaggtcgagcgggcggtgctggacgacggcatctaccgcatcatgcagcgggggctgctcggccgctcccaggtgggggtcggcgtgttccaggagaacgtgttccacaccatgtggcacgtcacccgcggggccgtgctgatgtaccagggcaagcgcctggagcccagctgggcctccgtgaagaaggacctcatcagctacggcgggggctggcggctgcgcgggtcctggaacacgggcgaggaggtccaggtgatcgccgtggagcccgggaagaaccccaagaacgtccagaccgcccccggcaccttcaagacccccgagggcgaggtgggggcgatcgccctggacttcaagcccggcacgagcgggtcccccatcgtgaaccgggagggcaagatcgtcggcctctacgggaacggcgtggtgaccaccagcgggacctacgtcagcgccatcgcccaggcgaaggcctcccaggagggcccgctgcccgagatcgaggacgaggtgttccgcaagcggaacctgacgatcatggacctccaccccgggagcggcaagacccgccggtacctgccggccatcgtgcgcgaggccatcaagcgcaagctgcggaccctcatcctggcccccacccgcgtcgtggcgtccgagatggccgaggccctgaagggcatgcccatccggtaccagacgaccgccgtcaagagcgagcacaccgggaaggagatcgtcgacctcatgtgccacgccaccttcacgatgcgcctgctgtcccccgtgcgggtgccgaactacaacatgatcatcatggacgaggcgcacttcaccgaccccagctccatcgccgcccgcggctacatcagcacccgggtcgggatgggcgaggccgccgcgatcttcatgaccgccacgccgcccgggtccgtggaggccttcccgcagagcaacgccgtgatccaggacgaggagcgcgacatccccgagcggtcctggaacagcggctacgagtggatcaccgacttccccggcaagaccgtctggttcgtgccctccatcaagagcgggaacgacatcgcgaactgcctccgcaagaacggcaagcgggtgatccagctgtcccgcaagaccttcgacacggagtaccagaagaccaagaacaacgactgggactacgtcgtgaccaccgacatcagcgagatgggggccaacttccgggccgaccgcgtgatcgacccgcggcgctgcctgaagcccgtcatcctcaaggacggccccgagcgggtgatcctggccgggcccatgccggtgacggtcgcctccgcggcccagcgccggggccgcatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgcggccgtggacggcgagtaccgcctccgcggggaggcccgcaagaccttcgtcgagctgatgcggcgcggcgacctgcccgtgtggctctcctacaaggtggccagcgagggcttccagtacagcgaccggcgctggtgcttcgacggggagcggaacaaccaggtcctggaggagaacatggacgtggagatctggacgaaggagggcgagcgcaagaagctgcggccccgctggctcgacgcccggacctactccgaccccctggcgctgcgcgagttcaaggagttcgccgccgggcggcgcagcgtgtccggcgacctcatcctggagatcggcaagctgccgcagcacctcacccagcgggcccagaacgcgctggacaacctggtcatgctccacaacagcgagcagggcgggcgcgcctaccggcacgccatggaggagctgcccgacaccatcgagacgctgatgctcctggccctgatcgccgtgctcaccgggggcgtgaccctgttcttcctgtccgggcgcggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcacggtcgcggccaacgagatggggctgctggagaccaccaagaaggacctcggcatcgggcacgtggccgtggagaaccaccaccacgccgccatgctggacgtcgacctgcaccccgcgtccgcctggaccctctacgccgtggccacgaccatcatcaccccgatgatgcgccacaccatcgagaacacgaccgccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgacggccgccgtgctcatgctggtggcccactacgccatcatcgggccgggcctgcaggcgaaggccacccgggaggcccagaagcgcaccgccgccgggatcatgaagaaccccaccgtcgacggcatcgtggcgatcgacctcgaccccgtggtctacgacgccaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtgagcatggcgaacatcttccgcggctcctacctggccggcgccgggctcgccttcagcctgatgaagtccctgggcgggggccggcgcgggaccggcgcgcagggcgagaccctcggggagaagtggaagcggcagctgaaccagctgtccaagagcgagttcaacacctacaagcgctccggcatcatggaggtggaccggagcgaggccaaggaggggctcaagcgcggcgagacgaccaagcacgccgtctcccgggggaccgccaagctgcgctggttcgtggagcggaacctggtgaagcccgagggcaaggtcatcgacctgggctgcgggcgcggcgggtggagctactactgcgccggcctcaagaaggtgaccgaggtgaaggggtacacgaagggcggccccgggcacgaggagcccatcccgatggcgacctacggctggaacctggtcaagctgcactccgggaaggacgtgttcttcatcccgcccgagaagtgcgacaccctcctgtgcgacatcggcgagagctcccccaacccgaccatcgaggaggggcggacgctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacccacgagatgtactgggtgtcctgcggcaccgggaacatcgtgagcgccgtcaacatgacctcccgcatgctcctgaaccggttcacgatggcccaccgcaagcccacctacgagcgggacgtggacctgggcaccggcacccgccacgtggccgtcgagcccgaggtggccaacctcgacatcatcgggcagcggatcgagaacatcaagcacgagcacaagagcacgtggcactacgacgaggacaacccctacaagacctgggcgtaccacggctcctacgaggtgaagccgagcgggtccgccagcagcatggtcaacggcgtggtcaagctgctgaccaagccctgggacgtgatccccatggtgacccagatcgccatgacggacaccacccccttcgggcagcagcgcgtcttcaaggagaaggtggacacccggacgccgaaggccaagcgcggcaccgcccagatcatggaggtgaccgcgcggtggctctggggcttcctgtcccgcaacaagaagccccggatctgcacccgcgaggagttcacgcggaaggtccgcagcaacgccgccatcggggccgtgttcgtggacgagaaccagtggaactccgcgaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcgcgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgccgacgacaccgccgggtgggacacccgcatcacggaggacgacctccagaacgaggccaagatcaccgacatcatggagccggagcacgcgctgctggccaaggccatcttcaagctcacctaccagaacaaggtggtgcgggtccagcgccccgccaagaacggcaccgtgatggacgtgatctcccggcgcgaccagcgggggagcggccaggtcggcacgtacgggctgaacaccttcaccaacatggaggcccagctgatccgccagatggagtccgagggcatcttcagcccctccgagctcgagacccccaacctggcggagcgggccctggactggctcgagaagtacggggtggagcgcctgaagcggatggccatcagcggcgacgactgcgtggtcaagccgatcgacgaccgcttcgccacggccctgaccgcgctcaacgacatggggaaggtgcggaaggacatcccccagtgggagccctccaagggctggaacgactggcagcaggtccccttctgcagccaccacttccaccagctgatcatgaaggacggccgcgagatcgtcgtgccgtgccggaaccaggacgagctggtggggcgcgcccgggtctcccagggcgccgggtggagcctccgcgagaccgcctgcctgggcaagagctacgcgcagatgtggcagctgatgtacttccacaagcgggacctccgcctggccgccaacgccatctgctccgccgtgcccgtggactgggtccccaccagccggacgacctggtccatccacgcgcaccaccagtggatgaccaccgaggacatgctgagcgtgtggaaccgcgtgtggatcgaggagaacccctggatggaggacaagacgcacatctccagctgggaggacgtcccgtacctcgggaagcgcgaggaccagtggtgcggctccctgatcggcctgaccgcccgggccacctgggccaccaacatccaggtggccatcaaccaggtgcgccggctcatcgggaacgagaactacctggactacatgaccagcatgaagcgcttcaagaacgagtccgaccccgagggcgcgctgtggtga

SEQ ID NO: 8593 - RNA, 9879 nt, synthetic construct
  misc_feature 1..9879: note = derived and/or modified CDS sequence (opt1) from DENV-1__FJ898421__SS-prME
  source 1..9879: mol_type = other RNA
agcgtgaccatgctgctcatgctgatgcccaccgccctggccttccacctcaccacccgcggcggggagccccacatgatcgtgtccaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctccatcagcatcatgatcgaggaggtcatgcggtcccgctggagccggaagatgctgatgaccgggaccctggccgtgttcttcctcctgatcatgggccagctgacgtggaacgacctcatccgcctgtgcatcatggtgggggcgaacgcctccgaccgcatgggcatgggcaccacctacctggccctcatggccaccttcaagatgcggccgatgttcgccgtcgggctgctgttccgccggctcacgagccgcgaggtgctgctgctcaccatcggcctgtccctggtggcgagcgtcgagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgcccgtgctgctcgggtccctgggctgcaagccgctgacgatgttcctcatcgccgagaacaagatctgggggcggaagtcctggcccctgaacgagggcatcatggccgtggggatcgtcagcatcctgctctccagcctgctgaagaacgacgtgcccctcgccggccccctgatcgccggcgggatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgcgacgacaccctcaccatcctgctgaaggccaccctcctggccgtcagcggggtgtacccgctgtccatccccgccaccctcttcgtgtggtacttctggcagaagaagaagcagcggagcggcgtcctgtgggacacccccagcccgcccgaggtggagcgcgccgtgctggacgacggcatctaccggatcatgcagcgcgggctgctcggccggagccaggtcggggtgggcgtgttccaggagaacgtcttccacaccatgtggcacgtgacccgcggggcggtgctgatgtaccagggcaagcggctggagccctcctgggccagcgtcaagaaggacctcatctcctacggcgggggctggcgcctgcgggggagctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgtccgggagccccatcgtcaaccgcgagggcaagatcgtgggcctctacgggaacggcgtggtcaccaccagcgggacctacgtgtccgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaagggcatgcccatccgctaccagacgaccgccgtcaagtccgagcacaccgggaaggagatcgtggacctcatgtgccacgccaccttcacgatgcggctgctgagccccgtgcgcgtcccgaactacaacatgatcatcatggacgaggcccacttcaccgacccctccagcatcgcggcccggggctacatctccacccgcgtggggatgggcgaggccgccgccatcttcatgaccgcgacgccgcccgggagcgtggaggccttcccgcagtccaacgccgtcatccaggacgaggagcgggacatccccgagcgcagctggaactccggctacgagtggatcaccgacttccccggcaagaccgtgtggttcgtgcccagcatcaagtccgggaacgacatcgccaactgcctccggaagaacggcaagcgcgtcatccagctgagccggaagaccttcgacacggagtaccagaagaccaagaacaacgactgggactacgtggtgaccaccgacatctccgagatgggggcgaacttccgcgccgaccgggtcatcgacccgcgccggtgcctgaagcccgtgatcctcaaggacggccccgagcgcgtgatcctggccgggcccatgccggtcacggtggccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctcagctacaaggtcgccagcgagggcttccagtactccgaccgccggtggtgcttcgacggggagcgcaacaaccaggtgctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtcagcggcgacctcatcctggagatcggcaagctgccgcagcacctcacccagcgcgcccagaacgccctggacaacctggtgatgctccacaactccgagcagggcgggcgggcgtaccgccacgccatggaggagctgcccgacaccatcgagacgctgatgctcctggccctgatcgccgtgctcaccgggggcgtcaccctgttcttcctgagcgggcggggcctcggcaagacctccatcgggctgctgtgcgtgatggccagctccgtgctcctgtggatggcgagcgtcgagccccactggatcgccgcctccatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtccccctgctggccctcggctgctactcccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgagccagatcctgctcatgcgcaccacctgggccctgtgcgagtccatcaccctggccacggggcccctcaccaccctgtgggagggcagcccggggaagttctggaacaccacgatcgccgtgtccatggccaacatcttccggggcagctacctggcgggcgccgggctcgccttcagcctgatgaagtccctgggcgggggccgccgggggaccggcgcccagggcgagaccctcggggagaagtggaagcgccagctgaaccagctgagcaagtccgagttcaacacctacaagcggagcggcatcatggaggtcgaccgctccgaggcgaaggaggggctcaagcggggcgagacgaccaagcacgccgtgagccgcgggaccgccaagctgcggtggttcgtggagcgcaacctggtcaagcccgagggcaaggtgatcgacctgggctgcgggcggggcgggtggtcctactactgcgccggcctcaagaaggtgaccgaggtcaaggggtacacgaagggcggccccgggcacgaggagcccatcccgatggccacctacggctggaacctggtgaagctgcacagcgggaaggacgtgttcttcatcccgcccgagaagtgcgacaccctcctgtgcgacatcggcgagtccagccccaacccgaccatcgaggaggggcgcacgctgcgggtcctcaagatggtggagccctggctgcgcggcaaccagttctgcatcaagatcctgaacccctacatgccctccgtggtcgagaccctcgagcagatgcagcggaagcacggcgggatgctggtgcgcaacccgctgagccggaactccacccacgagatgtactgggtgagctgcggcaccgggaacatcgtctccgcggtgaacatgaccagccgcatgctcctgaaccgcttcacgatggcccaccggaagcccacctacgagcgcgacgtggacctgggcaccggcacccggcacgtcgccgtggagcccgaggtggccaacctcgacatcatcgggcagcgcatcgagaacatcaagcacgagcacaagtccacgtggcactacgacgaggacaacccctacaagacctgggcctaccacggcagctacgaggtcaagccgtccgggagcgcgagctccatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctctggggcttcctgagccggaacaagaagccccgcatctgcacccgggaggagttcacgcgcaaggtgcggtccaacgcggccatcggggccgtgttcgtcgacgagaaccagtggaacagcgccaaggaggcggtggaggacgagcgcttctgggacctggtgcaccgggagcgcgagctccacaagcagggcaagtgcgcgacctgcgtctacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccctgagcggcgtggagggggagggcctccacaagctggggtacatcctgcgggacatctccaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacggcaccgtgatggacgtcatcagccgccgggaccagcgcgggtccggccaggtgggcacgtacgggctgaacaccttcaccaacatggaggcccagctgatccggcagatggagagcgagggcatcttctcccccagcgagctcgagacccccaacctggccgagcgcgcgctggactggctcgagaagtacggggtggagcggctgaagcgcatggccatctccggcgacgactgcgtcgtgaagccgatcgacgaccggttcgccacggccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcgcgcgtgagccagggcgccgggtggagcctccgggagaccgcctgcctgggcaagtcctacgcccagatgtggcagctgatgtacttccaccgccgggacctccgcctggcggccaacgccatctgcagcgccgtgcccgtcgactgggtgcccacctcccggacgacctggagcatccacgcccaccaccagtggatgaccaccgaggacatgctgtccgtgtggaaccgcgtctggatcgaggagaacccctggatggaggacaagacgcacatcagctcctgggaggacgtgccgtacctcgggaagcgcgaggaccagtggtgcggcagcctgatcggcctgaccgcgcgggccacctgggccaccaacatccaggtggccatcaaccaggtccgccggctcatcgggaacgagaactacctggactacatgacctccatgaagcgcttcaagaacgagagcggccccgagggggccctgtggtga

SEQ ID NO: 8594 - RNA, 9879 nt, synthetic construct
  misc_feature 1..9879: note = derived and/or modified CDS sequence (opt1) from DENV-1__FJ898423__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtcgactgctggtgcaacaccacggacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcatccagtacgagaacctgaagtacagcgtgatcgtgaccgtccacaccggcgaccagcaccaggtggggaacgagtccacggagcacggcaccatcgccaccatcacgccccaggcgcccaccagcgagatccagctcacggactacggggccctgaccctggactgcagcccccggaccggcctcgacttcaacgagatggtcctgctgaccatgaaggagaagtcctggctcgtgcacaagcagtggttcctggacctgcccctcccctggacgagcggggcctccaccagccaggagacctggaaccgccaggacctgctggtgaccttcaagacggcccacgccaagaagcaggaggtcgtggtgctcggctcccaggagggcgcgatgcacaccgccctgaccggggccaccgagatccagacgaccggcaccaccacgatcttcgccgggcacctgaagtgccggctcaagatggacaagctgaccctgaagggcatgagctacgtcatgtgcaccgggtccttcaagctcgagaaggaggtggccgagacccagcacggcacggtgctggtccagatcaagtacgagggcaccgacgcgccctgcaagatccccttcagcacccaggacgagaagggggtgacccagaacggccgcctgatcacggccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccggatggccatcctgggcgacaccgcgtgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcatcaccctgtacctgggcgtcatggtgcaggccgactccgggtgcgtgatcaactggaagggccgcgagctcaagtgcgggagcggcatcttcgtcaccaacgaggtgcacacgtggaccgagcagtacaagttccaggccgacagcccgaagcggctgtccgcggccatcggcaaggcctgggaggagggggtgtgcggcatccgcagcgccacccggctggagaacatcatgtggcgccagatctccaacgagctcaaccacatcctgctggagaacgacatgaagttcaccgtcgtggtgggggacgtcgtgggcatcctcgcccaggggaagaagatggtgcggccccagcccatggagcacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcttcctgctcatcatggggcagctgacctggaacgacctgatccggagctgcatcatggtgggcgccaacgcctccgaccgcatggggatgggcacgacctacctcgcgctgatggccaccttcaagatgcgcccgatgttcgccgtgggcctcctgttccggcgcctgaccagccgggaggtcctgctcctgacgatcgggctgtccctcgtggccagcgtcgagctgcccaactccctggaggagctcggcgacgggctggccatgggcatcatgatcctgaagctcctgaccgacttccagagctaccagctgtgggcgaccctcctgtccctgaccttcatcaagacgaccttcagcctccactacgcctggaagaccatggccatggtgctgtccatcgtgagcctgctccccctgtgcctgtccaccacgagccagaagaccacctggctccccgtcctgctgggctccctcgggtgcaagccgctgaccatgttcctgatcgccgagaacaagatctggggccgcaagagctggcccctcaacgaggggatcatggcggtgggcatcgtgagcatcctgctgtccagcctcctgaagaacgacgtccccctggccgggcccctcatcgccggcggcatgctgatcgcctgctacgtgatctccgggagctccgccgacctgagcctcgagaaggcggccgaggtgtcctgggaggaggaggccgagcacagcggcgcctcccacaacatcctggtcgaggtgcaggacgacgggacgatgaagatcaaggacgaggagcgggacgacaccctgaccatcctcctgaaggccaccctgctcgcggtgagcggcgtctacccgctgtccatccccgccaccctgttcgtgtggtacttctggcagaagaagaagcagcgcagcggggtgctctgggacacgcccagcccgcccgaggtcgagcgggccgtgctggacgacggcatctaccgcatcatgcagcggggcctgctggggcgcagccaggtgggcgtcggggtgttccaggagaacgtgttccacaccatgtggcacgtcacccggggcgccgtgctcatgtaccaggggaagcgcctggagccctcctgggccagcgtgaagaaggacctgatctcctacggcggcgggtggcggctccagggcagctggaacaccggggaggaggtccaggtgatcgcggtggagcccggcaagaaccccaagaacgtccagacggcccccgggaccttcaagacccccgagggcgaggtgggcgccatcgccctggacttcaagcccgggacctccggcagccccatcgtgaaccgcgaggggaagatcgtcggcctgtacggcaacggggtggtgacgaccagcggcacctacgtctccgccatcgcgcaggccaaggccagccaggaggggccgctccccgagatcgaggacgaggtgttccggaagcgcaacctgaccatcatggacctgcaccccggctccgggaagacgcggcgctacctcccggccatcgtgcgggaggcgatcaagcgcaagctgcggaccctgatcctcgcccccacccgcgtcgtggccagcgagatggccgaggccctgaagggcatgcccatccgctaccagaccacggcggtgaagtccgagcacaccggccgggagatcgtcgacctgatgtgccacgccaccttcaccatgcgcctcctgagccccgtgcgggtgccgaactacaacatgatcatcatggacgaggcccacttcacggacccctccagcatcgccgcccgcgggtacatctccacccgggtcggcatgggggaggcggccgccatcttcatgaccgccacgccgcccggcagcgtggaggccttcccgcagtccaacgcggtgatccaggacgaggagcgcgacatccccgagcggagctggaactccgggtacgagtggatcacggacttccccggcaagaccgtctggttcgtgcccagcatcaagtccggcaacgacatcgccaactgcctgcgcaagaacgggaagcgggtgatccagctcagccgcaagaccttcgacaccgagtaccagaagacgaagaacaacgactgggactacgtcgtgaccaccgacatctccgagatgggcgccaacttccgggccgaccgcgtgatcgacccgcggcgctgcctgaagcccgtcatcctgaaggacgggcccgagcgggtgatcctcgcgggccccatgccggtcaccgtggccagcgccgcccagcgccgggggcgcatcggccggaaccacaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgcgagaagtccgccgccatcgacggggagtaccgcctgcggggcgaggcccgcaagaccttcgtggagctcatgcggcgcggggacctgcccgtctggctgagctacaaggtggcgagcgagggcttccagtactccgaccggcgctggtgcttcgacggcgagcggaacaaccaggtgctcgaggagaacatggacgtcgagatctggaccaaggagggggagcgcaagaagctgcggccccgctggctggacgcccggacgtacagcgaccccctcgccctgcgcgagttcaaggagttcgccgccggccggcgctccgtgagcggggacctgatcctcgagatcggcaagctgccgcagcacctgacccagcgggcgcagaacgccctcgacaacctggtgatgctgcacaactccgagcagggcgggcgcgcctaccggcacgccatggaggagctccccgacaccatcgagaccctgatgctgctcgcgctgatcgccgtcctgacgggcggggtgaccctcttcttcctgagcggccgcgggctgggcaagacctccatcggcctcctgtgcgtgatggccagctccgccctgctctggatggccagcgtcgagccccactggatcgcggcctccatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagacgaccaagaaggacctggggatcggccacgtggcggtcgagaaccaccaccacgccaccatgctcgacgtggacctgcaccccgccagcgcctggaccctgtacgccgtggcgacgaccatcatcaccccgatgatgcggcacaccatcgagaacacgaccgccaacatctccctcaccgccatcgccaaccaggccgcgatcctgatggggctggacaagggctggcccatcagcaagatggacatcggcgtccccctcctggccctggggtgctactcccaggtgaaccccctcaccctgacggccgccgtgctgatgctcgtcgcgcactacgccatcatcggcccggggctgcaggccaaggccacccgcgaggcccagaagcgcaccgcggccggcatcatgaagaaccccaccgtggacgggatcgtggccatcgacctggaccccgtcgtgtacgacgccaagttcgagaagcagctcggccagatcatgctgctgatcctctgcacgagccagatcctgctgatgcggaccacctgggccctctgcgagtccatcaccctggcgacgggccccctgaccaccctctgggaggggagcccgggcaagttctggaacaccacgatcgccgtgtccatggccaacatcttccgcgggagctacctggccggcgccggcctggcgttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtcgaccggtccgaggccaaggagggcctgcgccgcggggagacgaccaagcacgccgtgagccgcggcaccgcgaagctccggtggttcgtggagcgcaacctggtcaagcccgaggggaaggtgatcgacctgggctgcggccgcggcgggtggtcctactactgcgccgggctgaagaaggtgaccgaggtcaaggggtacacgaagggcggccccggccacgaggagcccatcccgatggccacctacgggtggaacctcgtgaagctgcacagcggcaaggacgtgttcttcatcccgcccgagaagtgcgacaccctgctctgcgacatcggggagtccagccccaacccgaccatcgaggagggccgcacgctgcgggtcctgaagatggtggagccctggctccgcgggaaccagttctgcatcaagatcctgaacccctacatgccctccgtggtcgagaccctggagcacatgcagcggaagcacggcggcatgctcgtgcgcaacccgctgagccggaactccacccacgagatgtactgggtgagctgcgggaccggcaacatcgtctccgccgtgaacatgaccagccgcatgctgctcaaccgcttcacgatggcccaccggaagcccacctacgagcgcgacgtggacctgggggcgggcacccggcacgtcgccgtggagcccgaggtggccaacctggacatcatcggccagcgcatcgagaacatcaagcacgagcacaagtccacctggcactacgacgaggacaacccctacaagacgtgggcctaccacgggagctacgaggtcaagccgtccggcagcgccagctccatggtgaacggggtcgtgaagctcctgaccaagccctgggacgtgatccccatggtcacccagatcgcgatgaccgacacgacccccttcggccagcagcgggtgttcaaggagaaggtggacacccgcaccccgaaggccaagcgggggacggcccagatcatggaggtcaccgcccgctggctgtggggcttcctcagccggaacaagaagccccgcatctgcacccgggaggagttcacccgcaaggtgcggtccaacgccgcgatcggcgccgtgttcgtcgacgagaaccagtggaacagcgccaaggaggccgtggaggacgagcgcttctgggacctggtgcaccgggagcgcgagctgcacaagcaggggaagtgcgcgacgtgcgtctacaacatgatgggcaagcgggagaagaagctcggggagttcggcaaggccaaggggtcccgcgccatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgcggacgacaccgccggctgggacacccgcatcaccgaggacgacctgcagaacgaggccaagatcacggacatcatggagccggagcacgccctcctggccaccagcatcttcaagctgacctaccagaacaaggtggtccgcgtgcagcggcccgcgaagaacgggaccgtgatggacgtcatctcccgccgggaccagcgcggcagcggccaggtgggcacgtacggcctcaacaccttcaccaacatggaggcccagctgatccggcagatggagtccgaggggatcttcagcccctccgagctggagacccccaacctcgccgagcgcgtgctggactggctggagaagtacggcgtcgagcggctcaagcgcatggccatcagcggggacgactgcgtggtgaagccgatcgacgaccggttcgccacggcgctgaccgccctgaacgacatgggcaaggtccgcaaggacatcccccagtgggagccctccaaggggtggaacgactggcagcaggtccccttctgcagccaccacttccaccagctcatcatgaaggacggccgggagatcgtggtcccgtgccgcaaccaggacgagctggtgggccgggcccgcgtgagccagggggccggctggtccctgcgggagaccgcctgcctcgggaagtcctacgcgcagatgtggcagctgatgtacttccaccgccgggacctgcgcctcgccgccaacgccatctgctccgcggtccccgtggactgggtgcccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctggggaagcgcgaggaccagtggtgcggctccctcatcggcctgaccgcccgggccacctgggccaccaacatccaggtcgcgatcaaccaggtgcgccggctgatcgggaacgagaactacctcgactacatgaccagcatgaagcgcttcaagaacgagtccgaccccgagggcgccctgtggtga

SEQ ID NO: 8595 - RNA, 9879 nt, synthetic construct
  misc_feature 1..9879: note = derived and/or modified CDS sequence (opt1) from DENV-1__FJ898424__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcaccggggtgaacatgtgcaccctcatcgccatggacctgggcgagctgtgcgaggacaccatgacctacaagtgcccccggatcaccgaggtggagcccgacgacgtggactgctggtgcaacacgaccgacacctgggtgacctacgggacgtgcagccagaccggcgagcaccggcgcgacaagcggagcgtggccctcgcgccccacgtcggcctggggctggagacccgggccgagacctggatgagctccgagggcgcctggaagcagatccagaaggtggagacgtgggccctccggcaccccgggttcaccgtgatcgccctgttcctggcccacgccatcggcaccagcatcacccagaaggggatcatcttcatcctcctgatgctggtcacgccctccatggcgatgcgctgcgtgggcatcggcagccgggacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcgcaagctctgcatcgaggccaagatctccaacaccacgaccgacagccggtgcccgacccagggcgaggcgaccctggtcgaggagcaggacgccaacttcgtgtgccgccggacgttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccagcgagatccagctcaccgactacggggcgctgaccctggactgcagcccccggacgggcctcgacttcaacgagatggtgctgctgaccatgaaggagaagtcctggctcgtgcacaagcagtggttcctggacctgcccctcccctggaccagcggggcctccaccagccaggagacgtggaaccgccaggacctgctggtcaccttcaagaccgcccacgccaagaagcaggaggtggtggtcctcggctcccaggagggcgccatgcacaccgcgctgacgggggccaccgagatccagaccagcggcaccacgaccatcttcgccgggcacctgaagtgccggctcaagatggacaagctgaccctgaagggcatgtcctacgtgatgtgcaccgggagcttcaagctcgagaaggaggtggccgagacgcagcacggcaccgtcctggtgcagatcaagtacgagggcaccgacgccccctgcaagatccccttctccacccaggacgagaagggggtgacgcagaacggccgcctgatcaccgcgaacccgatcgtcaccgacaaggagaagcccgtgaacatcgaggccgagccgcccttcggggagagctacatcgtgatcggcgccggcgagaaggccctgaagctctcctggttcaagaaggggagctccatcggcaagatgttcgaggcgaccgcccgcggggcccgccggatggccatcctgggcgacacggcctgggacttcgggagcatcggcggcgtcttcacctccgtggggaagctggtgcaccagatcttcggcaccgcgtacggggtcctcttcagcggcgtgtcctggaccatgaagatcgggatcggcgtgctgctgacgtggctcggcctgaacagccgctccaccagcctgtccatgacctgcatcgccgtcgggctcgtgaccctgtacctgggcgtgatggtccaggccgacagcgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgctccgccacccggctggagaacatcatgtggcgccagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggccaagatcatcggcgcggacgtgcagaacacgaccttcatcatcgacgggcccaacaccccggagtgccccgacgaccagcgcgcctggaacatctgggaggtggaggactacggcttcgggatcttcaccacgaacatctggctgaagctgcgggactcctacacccaggtctgcgaccaccgcctcatgagcgccgccatcaaggactccaaggcggtgcacgccgacatgggctactggatcgagagcgagaagaacgagacctggaagctggcccgggcctccttcatcgaggtgaagacctgcatctggcccaagagccacacgctgtggtccaacggcgtcctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtggtggtcgacgagcactgcggcaaccgggggccgagcctgcgcaccaccaccgtgacgggcaagatcatccacgagtggtgctgccggtcctgcaccctgccgcccctccgcttcaagggggaggacggctgctggtacgggatggagatccggcccgtgaaggagaaggaggagaacctggtcaagagcatggtgagcgcgggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacgtggaacgacctgatccggtcctgcatcatggtgggcgccaacgccagcgaccgcatggggatgggcaccacctacctcgccctgatggcgaccttcaagatgcgcccgatgttcgccgtcggcctgctgttccggcgcctgacgtcccgggaggtgctgctcctgaccatcgggctgagcctcgtcgcctccgtggagctgcccaacagcctggaggagctcggcgacgggctggccatgggcatcatgatcctgaagctcctgaccgacttccagtcctaccagctgtgggccaccctcctgagcctgacgttcatcaagaccaccttctccctccactacgcgtggaagaccatggccatggtgctgagcatcgtctccctgctccccctgtgcctgagcacgacctcccagaagaccacctggctccccgtgctgctgggcagcctcgggtgcaagccgctgacgatgttcctgatcgccgagaacaagatctggggccgcaagagctggcccctcaacgaggggatcatggccgtgggcatcgtctccatcctgctgagctccctcctgaagaacgacgtgcccctggcggggcccctcatcgccggcggcatgctgatcgcctgctacgtgatcagcgggtccagcgccgacctgtccctcgagaaggccgcggaggtcagctgggaggaggaggccgagcactccggcgccagccacaacatcctggtggaggtgcaggacgacgggaccatgaagatcaaggacgaggagcgggacgacaccctgaccatcctcctgaaggccaccctgctcgccgtctccggcgtgtacccgctgagcatccccgcgacgctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgccgtgctcatgtaccaggggaagcgcctggagcccagctgggcctccgtcaagaaggacctgatcagctacggcggcgggtggcggctccagggctcctggaacacgggggaggaggtccaggtgatcgccgtcgagcccggcaagaaccccaagaacgtgcagaccgcgcccgggaccttcaagacccccgagggcgaggtgggcgccatcgccctggacttcaagcccgggacgagcggcagccccatcgtcaaccgcgaggggaagatcgtgggcctgtacggcaacggggtggtcaccacctccggcacctacgtgagcgccatcgcccaggcgaaggcctcccaggaggggccgctccccgagatcgaggacgaggtgttccggaagcgcaacctgacgatcatggacctgcaccccggcagcgggaagacccggcgctacctcccggccatcgtccgggaggccatcaagcgcaagctgcggaccctgatcctcgcgcccacccgcgtggtggcctccgagatggccgaggccctgaagggcatgcccatccgctaccagacgaccgccgtcaagagcgagcacaccggccgggagatcgtggacctgatgtgccacgcgaccttcacgatgcgcctcctgtcccccgtgcgggtcccgaactacaacatgatcatcatggacgaggcccacttcaccgaccccagctccatcgccgcccgcgggtacatcagcacccgggtgggcatgggggaggccgcggccatcttcatgaccgccacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgcgaactgcctgcgcaagaacgggaagcgggtcatccagctctcccgcaagaccttcgacacggagtaccagaagaccaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtcatcctcgccggccccatgccggtgacggtggcgtccgccgcccagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgcgctgttcgagccggagcgcgagaagtccgccgccatcgacggggagtaccgcctgcggggcgaggcccgcaagaccttcgtcgagctcatgcggcgcggggacctgcccgtgtggctgagctacaaggtggcctccgagggcttccagtacagcgaccggcgctggtgcttcgacggcgagcggaacaaccaggtcctcgaggagaacatggacgtggagatctggacgaaggagggggagcgcaagaagctgcggccccgctggctggacgcgcggacctactccgaccccctcgccctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagacgctgatgctgctcgccctgatcgcggtgctgaccggcggggtgaccctcttcttcctgtccggccgcgggctgggcaagaccagcatcggcctcctgtgcgtcatggcctccagcgccctgctctggatggcctccgtggagccccactggatcgccgcgagcatcatcctggagttcttcctgatggtgctcctgatccccgagccggaccggcagcgcacgccccaggacaaccagctggcctacgtcgtgatcgggctcctgttcatgatcctgacggtggccgccaacgagatgggcctcctggagaccaccaagaaggacctggggatcggccacgtcgccgtggagaaccaccaccacgcgaccatgctcgacgtggacctgcaccccgcctccgcctggacgctgtacgccgtcgccaccaccatcatcaccccgatgatgcggcacacgatcgagaacaccaccgcgaacatcagcctcaccgccatcgccaaccaggccgccatcctgatggggctggacaagggctggcccatctccaagatggacatcggcgtgcccctcctggcgctggggtgctacagccaggtgaaccccctcacgctgaccgccgccgtcctgatgctcgtggcccactacgcgatcatcggcccggggctgcaggccaaggccacccgcgaggcccagaagcgcaccgccgcgggcatcatgaagaaccccacggtggacgggatcgtcgccatcgacctggaccccgtggtgtacgacgccaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgcggtcagcatggccaacatcttccgcgggagctacctggccggcgccggcctggccttctccctcatgaagtccctcgggggcgggcggcgcgggaccggggcgcagggcgagaccctgggcgagaagtggaagcggcagctcaaccagctgtccaagagcgagttcaacacgtacaagcgctccgggatcatggaggtggaccggagcgaggccaaggagggcctgcgccgcggggagaccaccaagcacgccgtgtcccgcggcaccgccaagctccggtggttcgtcgagcgcaacctggtgaagcccgaggggaaggtgatcgacctgggctgcggccgcggcgggtggagctactactgcgcggggctgaagaaggtcacggaggtgaaggggtacaccaagggcgggcccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacgtcccgcatgctgctcaaccgcttcaccatggcccaccggaagcccacctacgagcgcgacgtcgacctgggggccggcacccggcacgtggcggtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggcagcgcctccagcatggtcaacggggtggtgaagctcctgaccaagccctgggacgtcatccccatggtgacccagatcgccatgacggacaccacccccttcggccagcagcgggtgttcaaggagaaggtcgacacccgcacgccgaaggcgaagcgggggaccgcccagatcatggaggtgaccgcccgctggctgtggggcttcctctcccggaacaagaagccccgcatctgcacccgggaggagttcacgcgcaaggtgcggagcaacgccgccatcggcgcggtcttcgtggacgagaaccagtggaactccgccaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggcgaaggggagccgcgccatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgcgggctgggacacccgcatcacggaggacgacctgcagaacgaggccaagatcaccgacatcatggagccggagcacgccctcctggccacctccatcttcaagctgacctaccagaacaaggtcgtgcgcgtgcagcggcccgcccgcaacgggacggtcatggacgtgatcagccggcgcgaccagcggggctccggccaggtgggcacctacggcctcaacaccttcaccaacatggaggcgcagctgatccgccagatggagagcgaggggatcttctcccccagcgagctggagacgcccaacctcgccgagcgggtcctggactggctggagaagcacggcgtggagcgcctcaagcggatggccatctccggggacgactgcgtggtcaagccgatcgacgaccgcttcgccaccgccctgagcgcgctgaacgacatgggcaaggtgcggaaggacatcccccagtgggagcccagcaaggggtggaacgactggcagcaggtccccttctgctcccaccacttccaccagctcatcatgaaggacggccgcgagatcgtcgtgccgtgccggaaccaggacgagctggtgggccgcgcccgggtcagccagggggccggctggtccctgcgcgagaccgcctgcctcggcaagagctacgcccagatgtggcagctgatgtacttccaccggcgcgacctgcggctcgcggccaacgccatctgctccgccgtgcccgtggactgggtccccaccagccgcacgacctggtccatccacgcgcaccaccagtggatgaccaccgaggacatgctgagcgtgtggaaccgcgtgtggatcgaggagaacccctggatggaggacaagacgcacatctccagctggggcgacgtcccgtacctggggaagcgggaggaccagtggtgcggctccctcatcggcctgaccgcccgcgccacctgggccaccaacatccaggtggccatcaaccaggtgcggcgcctgatcgggaacgagaactacctcgactacatgaccagcatgaagcggttcaagaacgagtccgaccccgagggcgcgctgtggtga

SEQ ID NO: 8596 - RNA, 9879 nt, synthetic construct
  misc_feature 1..9879: note = derived and/or modified CDS sequence (opt1) from DENV-1__FJ898425__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtcgggctcctgttccggcgcctgacgtcccgggaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtgctcagcatcgtctccctgatccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcggaccctcatcctggcccccacccgcgtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccaccatgctggacgtggacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgggaggcccagaagcgcaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacatctacaagcggtccgggatcatggaggtcgaccgcagcgaggccaaggagggcctcaagcgcggggagacgacccgccacgccgtgtcccggggcaccgcgaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcacgccgcccgagaagtgcgacaccctcctgtgcgacatcggggagagctcccccaacccgacgatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgccgtgaacatgacgtcccggatgctcctgaaccgcttcaccatggcccaccgcaagcccacctacgagaaggacgtggacctgggggcgggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacccagatcgcgatgacggacaccacccccttcggccagcagcgggtgttcaaggagaaggtggacacccgcacgccgaaggccaagcgggggaccgtccagatcatggaggtgaccgcccgctggctctggggcttcctgtcccggaacaagaagccccgcatctgcacccgggaggagttcacgcgcaaggtgcggagcaacgccgccatcggcgcggtcttcgtggacgagaaccagtggaactccgccaaggaggccgtggaggacgagcgcttctgggacctggtccagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgcgggctgggacacccggatcacggaggacgacctccagaacgaggccaagatcaccgacatcatggagccggagcacgccctgctggccacctccatcttcaagctcacctaccagaacaaggtcgtgcgcgtgcagcggcccgccaagaacgggacggtcatggacgtgatcagccgccgcgaccagcggggctccggccaggtgggcacctacggcctgaacaccttcaccaacatggaggcgcagctgatccgccagatggagagcgaggggatcttcctcccctccgagctggagacgcccaacctggccgagcgggtcctcgactggctggagaagtacggcgtggagcgcctgaagcggatggccatcagcggggacgactgcgtggtcaagccgatcgacgaccgcttcgccaccgccctcaccgcgctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcccgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggtccatccacgcgcaccaccagtggatgaccacggaggacatgctcagcgtgtggaaccgggtgtggatcgaggagaacccctggatggaggacaagacccacgtctccagctggggcgacgtgccgtacctggggaagcgcgaggaccagtggtgcggctccctgatcggcctcaccgcccgggccacctgggccagcaacatccaggtggccatcaaccaggtccgccgcctgatcgggaacgagaactacctggactacatgacctccatgaagcggttcaagaacgagggcgaccccgagggggcgctctggtga

SEQ ID NO: 8597 - RNA, 9879 nt, synthetic construct
  misc_feature 1..9879: note = derived and/or modified CDS sequence (opt1) from DENV-1__FJ898426__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcgcgaaccccgccgtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgcgaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgccaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggaaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccgcctgaagatggacaagctcacgctgaagggcatgtcctacgtcatgtgcaccgggagcttcaagctggagaaggaggtggccgagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggcggagccgcccttcggggagagctacatcgtgatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtgttcacctccgtcgggaagctggtgcaccagatcttcggcacggcctacggggtgctgttcagcggcgtctcctggaccatgaagatcgggatcggcgtgctcctgacctggctgggcctcaacagccgctccaccagcctgtccatgacgtgcatcgccgtggggctggtcaccctctacctgggcgtgatggtgcaggcggacagcgggtgcgtcatcaactggaagggccgggagctgaagtgcgggagcggcatcttcgtgaccaacgaggtgcacacctggacggagcagtacaagttccaggccgactccccgaagcgcctcagcgccgccatcggcaaggcctgggaggagggggtctgcggcatccggtccgcgacccgcctggagaacatcatgtggaagcagatcagcaacgagctgaaccacatcctcctggagaacgacatgaagttcaccgtggtggtcggggacgtggccggcatcctggcccaggggaagaagatgatccggccccagcccatggagtacaagtactcctggaagtcctggggcaaggccaagatcatcggcgcggacgtgcagaacaccaccttcatcatcgacgggcccaacacgccggagtgccccgacgaccagcgcgcctggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgcggacatgggctactggatcgagagcgagaagaacgagacgtggaagctcgcccgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtcgtggacgagcactgcggcaaccgggggccgagcctgcgcaccacgaccgtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgacgggcaccctcgcggtgttcttcctgctgatcatggggcagctcacctggaacgacctgatccggctgtgcatcatggtcggcgccaacgcctccgaccgcatggggatgggcaccacgtacctcgccctgatggccaccttcaagatgcgcccgatgttcgcggtggggctcctgttccggcgcctgaccagccgggaggtgctgctcctgaccatcgggctgtccctcgtcgccagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcgtggaagaccatggccatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgcgggcggcatgctcatcgcctgctacgtcatctccgggagctccgccgacctgagcctggagaaggccgccgaggtgtcctgggaggaggaggcggagcacagcggcgcctcccacaacatcctcgtggaggtccaggacgacgggaccatgaagatcaaggacgaggagcgggacgacacgctgaccatcctgctcaaggccaccctgctggccgtgagcggcgtgtacccgctctccatccccgccaccctgttcgtctggtacttctggcagaagaagaagcagcgcagcggggtgctgtgggacacccccagcccgcccgaggtggagcgggcggtcctcgacgacggcatctaccgcatcatgcagcggggcctgctggggcgcagccaggtgggcgtgggggtcttccaggagaacgtgttccacacgatgtggcacgtgacccggggcgccgtcctgatgtaccaggggaagcgcctcgagccctcctgggccagcgtgaagaaggacctgatctcctacggcggcgggtggcggctgcagggcagctggaacaccggggaggaggtgcaggtcatcgccgtggagcccggcaagaaccccaagaacgtgcagaccgcccccgggacgttcaagacctccgagggcgaggtcggcgcgatcgccctcgacttcaagcccgggaccagcggcagccccatcgtgaaccgcgaggggaagatcgtgggcctgtacggcaacggggtcgtgaccacgtccggcacctacgtgagcgccatcgcccaggcgaaggcctcccaggaggggcccctgccggagatcgaggacgaggtcttccggaagcgcaacctcaccatcatggacctgcaccccggcagcgggaagacccggcgctacctgcccgccatcgtgcgggaggccatcaagcgcaagctccggacgctgatcctggccccgacccgcgtggtcgcgtccgagatggccgaggccctcaagggcatgcccatccgctaccagaccaccgccgtcaagagcgagcacacgggcaaggagatcgtggacctgatgtgccacgccaccttcaccatgcggctgctctcccccgtccgcgtgcccaactacaacatgatcatcatggacgaggcgcacttcaccgacccgagctccatcgccgcccgggggtacatcagcacgcgcgtgggcatgggggaggccgccgcgatcttcatgaccgccacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgcgaactgcctgcggaagaacgggaagcgcgtgatccagctgtcccggaagaccttcgacaccgagtaccagaagaccaagaacaacgactgggactacgtggtcacgaccgacatcagcgagatgggcgccaacttccgcgccgaccgggtgatcgacccccgccggtgcctcaagccggtgatcctgaaggacgggcccgagcgcgtcatcctggccggccccatgcccgtgaccgtcgcctccgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggcgctccgggagttcaaggagttcgccgccggccgccggagcgtctccggggacctgatcctggagatcggcaagctcccccagcacctgacgcagcgcgcccagaacgcgctggacaacctcgtgatgctgcacaacagcgagcagggcgggcgggcctaccgccacgccatggaggagctgccggacaccatcgagaccctcatgctgctggccctcatcgccgtgctgaccggcggggtcacgctgttcttcctctccggccgggggctgggcaagaccagcatcggcctgctctgcgtgatggcgtccagcgtgctgctgtggatggcctccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagaccacgaagaaggacctggggatcggccacgtggccgtcgagaaccaccaccacgccgccatgctggacgtggacctccaccccgcgtccgcctggaccctgtacgccgtggccaccaccatcatcacgcccatgatgcgccacaccatcgagaacaccaccgccaacatcagcctgacggcgatcgccaaccaggccgccatcctcatggggctggacaagggctggccgatctccaagatggacatcggcgtccccctgctcgcgctggggtgctacagccaggtgaaccccctgaccctcaccgccgccgtgctgatgctggtcgcccactacgccatcatcggccccgggctccaggcgaaggccacccgggaggcccagaagcgcacggccgccggcatcatgaagaacccgaccgtggacgggatcgtggcgatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggcgaacatcttccgggggagctacctcgccggcgccggcctggccttctccctgatgaagtccctcgggggcgggcgccggggcaccggggcgcagggcgagacgctgggcgagaagtggaagcgccagctgaaccagctctccaagagcgagttcaacacctacaagcggtccgggatcatggaggtcgaccgcagcgaggccaaggagggcctgaagcgcggggagaccaccaagcacgccgtgtcccgcggcacggccaagctgcggtggttcgtggagcgcaacctcgtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggcgacctacgggtggaacctggtgaagctccactccggcaaggacgtgttcttcatcccgcccgagaagtgcgacacgctgctgtgcgacatcggggagagctcccccaaccccaccatcgaggagggccgcaccctccgggtcctgaagatggtggagccgtggctgcgcgggaaccagttctgcatcaagatcctcaacccctacatgcccagcgtggtcgagaccctggagcagatgcagcggcgccacggcggcatgctggtgcggaaccccctctcccgcaacagcacgcacgagatgtactgggtgtcctgcgggaccggcaacatcgtcagcgccgtgaacatgacctcccggatgctgctgaaccgcttcaccatggcccaccgcaagccgacctacgagcgggacgtggacctcggggccggcacgcgccacgtcgccgtggagcccgaggtggcgaacctggacatcatcggccagcggatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctgctcaccaagccgtgggacgtgatccccatggtcacgcagatcgccatgaccgacaccacccccttcggccagcagcgcgtgttcaaggagaaggtggacacgcggacccccaaggccaagcgcgggaccgcgcagatcatggaggtcaccgccaagtggctgtggggcttcctgtcccggaacaagaagccgcgcatctgcacgcgggaggagttcacccgcaaggtgcggagcaacgccgccatcggcgcggtgttcgtcgacgagaaccagtggaactccgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgcgatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacgcgcatcaccgaggacgacctgcagaacgaggcgaagatcaccgacatcatggagcccgagcacgccctgctcgccaagtccatcttcaagctgacctaccagaacaaggtggtccgggtgcagcgcccggccaagaacgggacggtgatggacgtcatcagccgccgggaccagcgcggctccggccaggtgggcacctacggcctgaacaccttcaccaacatggaggcccagctcatccggcagatggagagcgaggggatcttctcccccagcgagctggagacgcccaacctggcgggccgcgtgctcgactggctggagaagcacggggtcgagcggctgaagcgcatggccatctccggcgacgactgcgtggtgaagcccatcgacgaccggttcgccaccgccctcaccgccctgaacgacatggggaaggtccgcaaggacatcccgcagtgggagcccagcaagggctggaacgactggcagcaggtccccttctgcagccaccacttccaccagctgatcatgaaggacggccgggagatcgtggtcccctgccgcaaccaggacgagctcgtggggcgggcgcgcgtgtcccagggcgccgggtggagcctgcgggagaccgcctgcctgggcaagtcctacgcccagatgtggcagctcatgtacttccaccgccgggacctgcgcctggcggccaacgccatctgcagcgccgtcccggtggactgggtgcccacgtcccggaccacctggagcatccacgcccaccaccagtggatgaccacggaggacatgctctccgtctggaaccgcgtgtggatcgaggagaacccctggatggaggacaagacccacatcagctcctggggcgacgtgccctacctgggcaagcgggaggaccagtggtgcggcagcctgatcgggctcaccgcgcgcgccacctgggccacgaacatccaggtcgccatcaaccaggtgcgccggctgatcggcaacgagaactacctggactacatgacctccatgaagcgcttcaagaacgagagcgacccggagggggccctctggtga

SEQ ID NO: 8598 - RNA, 9879 nt, synthetic construct
  misc_feature 1..9879: note = derived and/or modified CDS sequence (opt1) from DENV-1__GQ199856__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcgtggccatggacctgggggagttctgcgaggacacgatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtcaccccctccatggccatgcggtgcgtgggcatcggcagccgcgacttcgtggaggggctgtccggcgccacgtgggtcgacgtggtgctcgagcacgggagctgcgtcaccaccatggccaaggacaagcccaccctggacatcgagctgctcaagacggaggtgaccaaccccgcggtgctgcggaagctgtgcatcgaggccaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatcacgtgcgccaagttcaagtgcgtcaccaagctcgagggcaagaccgtgcagtacgagaacctgaagtacagcgtgatcgtcaccgtgcacacgggcgaccagcaccaggtcgggaacgagtccaccgagcacggcaccaccgcgaccatcacgccccaggcccccagcaccgagatccagctgaccgactacggggccctcaccctggactgcagcccccgcacgggcctggacttcaacgagatggtgctcctgaccatgaaggagaagtcctggctggtgcacaagcagtggttcctcgacctgccgctgccctggaccagcggggcctccaccagccaggagacgtggaaccggaaggacctcctggtcaccttcaagaccgcccacgcgaagaagcaggaggtggtggtcctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtgatgtgcaccgggagcttcaagctggagaaggaggtggcggagacgcagcacggcaccgtcctcgtgcagatcaagtacgagggcaccgacgccccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccgctccaccagcctgtccatgacctgcatcgccgtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatcgggcagctcacgtggaacgacctgatccggctgtgcatcatggtgggcgcgaacgcctccgaccgcatggggatgggcaccacctacctcgccctgatggccaccttcaagatgcgcccgatgttcgccgtgggcctcctgttccggcgcctgacgagccgggaggtcctgctcctgaccatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtgctgtccatcgtgagcctgttccccctctgcctgtccacgaccagccagaagaccacctggctgcccgtcctcctgggctccctggggtgcaagccgctcacgatgttcctgatcgccgagaacaagatctggggccgccggagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggaccatgaagatcaaggacgaggagcgcgacgacaccctgaccatcctgctcaaggccaccctgctggccgtgagcggcgtctacccgctctccatccccgccacgctgttcgtgtggtacttctggcagaagaagaagcagcggagcggggtgctgtgggacacccccagcccgcccgaggtcgagcgcgccgtgctcgacgacggcatctaccggatcatgcagcgcggcctgctggggcggagccaggtgggcgtcggggtgttccaggagaacgtgttccacaccatgtggcacgtcacccgcggcgcggtgctgatgtaccaggggaagcggctcgagccctcctgggccagcgtgaagaaggacctgatctcctacggcggcgggtggcgcctgcagggcagctggaacacgggggaggaggtccaggtgatcgccgtggagcccggcaagaaccccaagaacgtccagaccgcccccgggaccttcaagacctccgagggcgaggtgggcgccatcgcgctcgacttcaagcccgggacgagcggcagccccatcgtgaaccgggaggggaagatcgtcggcctgtacggcaacggggtggtgaccacctccggcacctacgtcagcgccatcgcccaggccaaggcgtcccaggaggggcccctgccggagatcgaggacgaggtgttccgcaagcggaacctcacgatcatggacctgcaccccggcagcgggaagacccgccggtacctgcccgccatcgtgcgcgaggccatcaagcggaagctccgcaccctgatcctggccccgacccgcgtcgtggcctccgagatggcggaggccctcaagggcatgcccatccggtaccagacgaccgccgtcaagagcgagcacaccggcaaggagatcgtcgacctgatgtgccacgccaccttcacgatgcgcctgctctcccccgtgcgggtgcccaactacaacatgatcatcatggacgaggcccacttcaccgacccgagctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatcccggagcggtcctggaacagcgggtacgagtggatcaccgacttccccggcaagaccgtctggttcgtgccctccatcaagagcggcaacgacatcgccaactgcctgcgcaagaacgggaagcgggtgatccagctgtcccgcaagaccttcgacacggagtaccagaagaccaagaacaacgactgggactacgtcgtgaccaccgacatcagcgagatgggcgcgaacttccgggccgaccgcgtgatcgacccccggcgctgcctcaagccggtcatcctgaaggacgggcccgagcgggtgatcctggccggccccatgcccgtcacggtggcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccgcctgcggggcgaggcccgcaagaccttcgtggagctgatgcggcgcggggacctcccggtctggctgagctacaaggtggcctccgagggcttccagtacagcgaccggcgctggtgcttcgacggcgagcggaacaaccaggtgctggaggagaacatggacgtcgagatctggacgaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagacgctcatgctgctggccctcatcgccgtcctgaccggcggggtgaccctgttcttcctctccggccgcgggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccggcagcgcaccccgcaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccgccatgctggacgtggacctccaccccgcctccgcgtggaccctgtacgccgtcgccacgaccatcatcacccccatgatgcggcacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgcgaggcccagaagcgcaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcggaccacctgggccctgtgcgagagcatcaccctcgccacgggccccctgaccaccctgtgggaggggtcccccggcaagttctggaacaccacgatcgccgtcagcatggccaacatcttccgcgggagctacctcgcgggcgccggcctggccttctccctgatgaagtccctcgggggcgggcggcgcggcaccggggcccagggcgagaccctgggcgagaagtggaagcggcagctgaaccagctctccaagagcgagttcaacacctacaagcgctccgggatcatggaggtggaccggagcgaggcgaaggagggcctgaagcgcggggagacgaccaagcacgccgtgtcccggggcaccgccaagctgcgctggttcgtcgagcggaacttcgtgaagccggaggggaaggtgatcgacctcggctgcggccgcgggggctggagctactactgcgccgggctgaagaaggtcaccgaggtgaagggctacacgaagggcgggcccggccacgaggagcccatccccatggccacctacgggtggaacctggtgaagctgcactccggcaaggacgtcttcttcatcccgcccgagaagtgcgacaccctcctgtgcgacatcggggagagctcccccaaccccaccatcgaggagggccggacgctgcgcgtgctcaagatggtggagccgtggctgcgggggaaccagttctgcatcaagatcctgaacccctacatgcccagcgtcgtggagaccctcgagcgcatgcagcggaagcacggcggcatgctggtgcgcaaccccctgtcccggaacagcacccacgagatgtactgggtctcctgcgggaccggcaacatcgtgagcgcggtgaacatgacctcccgcatgctcctgaaccgcttcacgatggcccaccggaagccgacctacgagcgcgacgtcgacctgggggccggcacccggcacgtggccgtggagcccgaggtcgccaacctcgacatcatcggccagcgcatcgagaacatcaagcacgagcacaagctgacctggcactacgacgaggacaacccctacaagacgtgggcgtaccacgggagctacgaggtgaagccctccggcagcgccagctccatggtcaacggggtggtgaagctgctcaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcgaagtggctgtggggcttcctgagccgcaacaagaagccgcggatctgcacccgcgaggagttcacccggaaggtgcgctccaacgccgccatcggcgccgtcttcgtggacgagaaccagtggaacagcgcgaaggaggccgtggaggacgagcggttctgggacctcgtccaccgcgagcgggagctgcacaagcaggggaagtgcgccacgtgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcaccgaggacgacctgcagaacgaggccaagatcacggacatcatggagcccgagcacgcgctgctcgccaagagcatcttcaagctgacctaccagaacaaggtcgtgcgcgtgcagcgcccggccaagaacgggaccgtcatggacgtgatctcccggcgcgaccagcggggcagcggccaggtgggcacctacggcctgaacacgttcaccaacatggaggcccagctcatccgccagatggagtccgaggggatcttcagcccctccgagctggagacccccaacctggccggccgggtcctcgactggctggagaagcacggggtggagcgcctgaagcggatggcgatcagcggcgacgactgcgtggtcaagcccatcgacgaccgcttcgccaccgccctcacggccctgaacgacatggggaaggtgcggaaggacatcccgcagtgggagccctccaagggctggaacgactggcagcaggtccccttctgcagccaccacttccaccagctgatcatgaaggacggccgcgagatcgtcgtgccctgccggaaccaggacgagctcgtggggcgcgcccgggtcagccagggcgcggggtggtccctgcgcgagaccgcctgcctgggcaagagctacgcccagatgtggcagctcatgtacttccaccggcgcgacctgcggctggccgcgaacgccatctgctccgccgtgccggtggactgggtccccaccagccgcaccacgtggtccatccacgcccaccaccagtggatgaccaccgaggacatgctcagcgtgtggaaccgggtgtggatcgaggagaacccctggatggaggacaagacccacatctccagctggggcgacgtcccctacctgggcaagcgcgaggaccagtggtgcggctccctgatcgggctcacggcccgcgcgacctgggccaccaacatccaggtggccatcaaccaggtgcggcgcctgatcggcaacgagaactacctggactacatgaccagcatgaagcggttcaagaacgagtccgacccggagggggccctctggtga

SEQ ID NO: 8599 - RNA, 9879 nt, synthetic construct
  misc_feature 1..9879: note = derived and/or modified CDS sequence (opt1) from DENV-1__FJ898427__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactgcgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgacgatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggacgctgatcctggcccccacccgcgtggtggcctccgagatggccgaggcgctcaagggcatgcccatccgctaccagaccaccgccgtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacgcagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgaccggcggggtgaccctgttcttcctctccggccgggggctgggcaagacgagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgcctccgcctggaccctgtacgccgtggcgaccacgatcatcaccccgatgatgcgccacaccatcgagaacaccacggccaacatcagcctgaccgccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacgcgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcacgacctgggccctgtgcgagagcatcaccctcgcgaccggccccctgacgaccctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcacggcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacgcacgagatgtactgggtgtcctgcgggaccggcaacatcgtgagcgccgtcaacatgacctcccggatgctgctgaaccgcttcaccatggcccaccgcaagcccacgtacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacacggccggctgggacacccgcatcaccgaggacgacctgcagaacgaggccaagatcaccgacatcatggagccggagcacgccctgctcgccacgtccatcttcaagctgacctaccagaacaaggtggtgcgggtccagcgccccgcgaagaacgggaccgtgatggacgtgatcagccgccgggaccagcgcggctccgggcaggtcggcacctacggcctgaacacgttcaccaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgcgctgacggccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggaccacgtggtccatccacgcccaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacgtgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8600 - RNA, 9879 nt, synthetic construct
  misc_feature 1..9879: note = derived and/or modified CDS sequence (opt1) from DENV-1__JF937599__SS-prME
  source 1..9879: mol_type = other RNA
agcgtgaccatgctgctcatgctgatgcccaccgccctggccttccacctcaccgcccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcaccgaggccgagcccgacgacgtggactgctggtgcaacgccaccgacacctgggtgacgtacgggacctgcagccagaccggcgagcaccggcgggacaagcggtccgtggcgctggcgccccacgtgggcctcgggctggagacccgcacggagacctggatgagctccgagggcgcctggaagcagatccagcgggtggagacctgggccctgcgccaccccgggttcaccgtgatcgccctgttcctggcccacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggcgaaggacaagcccaccctggacatcgagctgctcaagaccgaggtcacgaaccccgccgtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgcgaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgccaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgcccctgccctggacgagcggggcctccaccagccaggagacctggaaccggcaggacctcctggtgaccttcaagacggcgcacgccaagaagcaggaggtcgtggtgctgggctcccaggagggcgccatgcacaccgccctcaccggggccaccgaggtccagacgagcggcaccaccaccatcttcgcggggcacctgaagtgccgcctgaagatggacaagctcacgctgaagggcatgtcctacgtgatgtgcaccgggagcttcaagctggagaaggaggtggccgagacccagcacggcaccgtcctcgtgcagatcaagtacgagggcacggacgccccctgcaagatccccttctccacccaggacgagaagggggtgacccagaacggccggctgatcaccgccaacccgatcgtcacggacaaggagaagcccgtgaacatcgaggcggagccgcccttcggggagagctacatcgtgatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtcttcacctccgtggggaagctggtgcaccagatcttcggcacggcctacggggtcctgttcagcggcgtgtcctggaccatgaagatcgggatcggcgtgctcctgacctggctgggcctcaacagccgctccaccagcctgtccatgacgtgcatcgccgtcgggctggtgaccctctacctgggcgtgatggtccaggcggacagcgggtgcgtgatcaactggaagggccgggagctgaagtgcgggagcggcatcttcgtgaccaacgaggtccacacctggacggagcagtacaagttccaggccgactccccgaagcgcctcagcgccgccatcggcaaggcctgggaggagggggtgtgcggcatccggtccgcgacccgcctggagaacatcatgtggaagcagatcagcaacgagctgaaccacatcctcctggagaacgacatgaagctgaccgtggtcgtgggggacgtggccggcatcctcgcccaggggaagaagatgatccggccccagcccatggagtacaagtactcctggaagtcctggggcaaggccaagatcatcggcgcggacgtccagaacaccaccttcatcatcgacgggcccaacacgccggagtgccccgacgaccagcgcgcctggaacatctgggaggtggaggactacggcttcgggatcttcaccaccaacatctggctgaagctgcgggactcctacacccaggtgtgcgaccaccgcctcatgagcgccgccatcaaggactccaaggccgtccacgcggacatgggctactggatcgagagcgagaagaacgagacgtggaagctggcccgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgacgggcaccctggcggtcttcttcctgctcatcatggggcagctgacctggaacgacctgatccggctctgcatcatggtgggcgccaacgcctccgaccgcatggggatgggcaccacgtacctggccctgatggccaccttcaagatgcgcccgatgttcgcggtgggcctcctgttccggcgcctgaccagccgggaggtcctcctgctgaccatcgggctctccctggtggccagcgtcgagctgcccaactccctcgaggagctgggcgacgggctggccatgggcatcatgatcctcaagctgctgacggacttccagagccaccagctctgggccaccctgctgtccctcaccttcatccgcaccacgttcagcctgcactacgcgtggaagaccatggccatggtgctgtccatcgtgagcctcttccccctgtgcctgtccaccaccagccagaagacgacctggctccccgtcctgctgggctccctcgggtgcaagccgctgaccatgttcctgatcgccgagaacaagatctggggccgcaagagctggcccctcaacgaggggatcatggccgtgggcatcgtgagcatcctgctgtccagcctcctgaagaacgacgtccccctggccgggcccctcatcgcgggcggcatgctgatcgcctgctacgtgatctccgggagctccgccgacctgagcctcgagaaggccgccgaggtgtcctgggaggaggaggcggagcacagcggcgcctcccacaacatcctggtcgaggtgcaggacgacgggaccatgaagatcaaggacgaggagcgcgacgacacgctgaccatcctcctgaaggccaccctgctcgccgtgagcggcgtctacccgctgtccatccccgccaccctgttcgtgtggtacttctggcagaagaagaagcagcggagcggggtgctctgggacacccccagcccgcccgaggtcgagcgcgcggtgctggacgacggcatctaccggatcatgcagcgcggcctgctggggcggagccaggtgggcgtcggggtgttccaggagaacgtgttccacacgatgtggcacgtcacccgcggcgccgtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaaccccaagaacgtccagaccgcccccgggacgttcaagacctccgagggcgaggtgggcgcgatcgccctggacttcaagcccgggaccagcggcagccccatcgtgaaccgggaggggaagatcgtcggcctgtacggcaacggggtggtgaccacgtccggcacctacgtcagcgccatcgcccaggcgaaggcctcccaggaggggcccctcccggagatcgaggacgaggtgttccgcaagcggaacctgaccatcatggacctgcaccccggcagcgggaagacccgccggtacctccccgccatcgtgcgcgaggccatcaagcggcgcctgcgcacgctgatcctcgccccgacccgggtcgtggcgtccgagatggccgaggccctgaagggcatgcccatccgctaccagaccaccgccgtcaagagcgagcacacgggcaaggagatcgtcgacctgatgtgccacgccaccttcaccatgcggctcctgtcccccgtgcgcgtgcccaactacaacatgatcatcatggacgaggcgcacttcaccgacccgagctccatcgccgcccgggggtacatcagcacgcgcgtcggcatgggggaggccgccgcgatcttcatgaccgccacgccgcccggctccgtggaggccttcccccagagcaacgccgtgatccaggacgaggagcgggacatcccggagcgctcctggaacagcgggtacgagtggatcaccgacttccccggcaagacggtctggttcgtgccctccatcaagagcggcaacgacatcgcgaactgcctgcggaagaacgggaagcgcgtgatccagctctcccggaagaccttcgacaccgagtaccagaagaccaagaacaacgactgggactacgtcgtgacgaccgacatcagcgagatgggcgccaacttccgcgccgaccgggtgatcgacccccgccggtgcctgaagccggtcatcctgaaggacgggcccgagcgcgtgatcctcgccggccccatgcccgtcaccgtggcctccgcggcccagcggcgcgggcggatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgcgagaagtccgcggccatcgacggggagtaccggctgcgcggcgaggcccggaagaccttcgtggagctcatgcgccgcggggacctgccggtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgcgctgcgggagttcaaggagttcgccgccggccgccggagcgtgtccggggacctgatcctcgagatcggcaagctgccccagcacctgacgcagcgcgcccagaacgcgctcgacaacctggtgatgctgcacaacagcgagcagggcgggcgggcctaccgccacgccatggaggagctcccggacaccatcgagaccctgatgctgctcgccctgatcgccgtcctgaccggcggggtgaccctcttcttcctgtccggccgggggctgggcaagaccagcatcggcctcctgtgcgtgatggcgtccagcgtcctgctctggatggcctccgtggagccccactggatcgccgccagcatcatcctggagttcttcctgatggtgctcctgatccccgagcccgaccgccagcggaccccgcaggacaaccagctggcctacgtcgtgatcgggctcctgttcatgatcctgaccgtggcggccaacgagatgggcctcctggagaccacgaagaaggacctggggatcggccacgtcgccgtggagaaccaccaccacgccgccatgctcgacgtggacctgcaccccgcgtccgcctggaccctgtacgccgtcgccaccaccatcatcacgcccatgatgcgccacaccatcgagaacaccaccgccaacatcagcctcacggcgatcgccaaccaggccgccatcctgatggggctggacaagggctggccgatctccaagatggacatcggcgtgcccctcctggcgctggggtgctacagccaggtgaaccccctcaccctgaccgccgccgtcctgatgctcgtggcccactacgccatcatcggccccgggctgcaggcgaaggccacccgcgaggcccagaagcggacggccgccggcatcatgaagaacccgaccgtggacgggatcgtcgcgatcgacctggaccccgtggtgtacgacgccaagttcgagaagcagctcggccagatcatgctgctgatcctctgcacctcccagatcctgctgatgcgcaccacgtgggccctctgcgagagcatcaccctggccaccggccccctgaccacgctctgggaggggtcccccggcaagttctggaacaccaccatcgccgtcagcatggcgaacatcttccgggggagctacctggccggcgccggcctggccttctccctcatgaagtccctcgggggcgggcgccgggggaccggggcgcagggcgagacgctgggcgagaagtggaagcgccagctcaaccagctgtccaagccggagttcaacacctacaagcggagcgggatcatggaggtggaccgctccgaggccaaggagggcctgaagcgcggggagaccaccaagcacgccgtgagccgcggcacggccaagctccggtggttcgtcgagcgcaacctggtgaagcccgaggggaaggtgatcgacctgggctgcggccgcggcgggtggtcctactactgcgccgggctgaagaaggtcaccgaggtgaaggggtacaccaagggcgggcccggccacgaggagcccatcccgatggcgacctacgggtggaacctcgtgaagctgcacagcggcaaggacgtcttcttcatcccgcccgagaagtgcgacacgctgctctgcgacatcggggagtccagccccaacccgaccatcgaggagggccgcaccctgcgggtgctgaagatggtggagccctggctccgcgggaaccagttctgcatcaagatcctgaacccctacatgccctccgtcgtggagaccctggagcagatgcagcggaagcacggcggcatgctcgtgcgcaacccgctgagccggaactccacgcacgagatgtactgggtcagctgcgggaccggcaacatcgtgtccgccgtgaacatgaccagccgcatgctgctcaaccgcttcaccatggcccaccggaagcccacctacgagcgcgacgtcgacctgggggccggcacgcggcacgtggccgtggagcccgaggtcgcgaacctggacatcatcggccagcgcatcgagaacatcaagcacgagcacaagtccacctggcactacgacgaggacaacccctacaagacctgggcctaccacgggagctacgaggtgaagccgtccggcagcgccagctccatggtcaacggggtggtgaagctcctgaccaagccctgggacgtcatccccatggtgacgcagatcgccatgaccgacaccacccccttcggccagcagcgggtgttcaaggagaaggtcgacacgcgcaccccgaaggccaagcgggggaccgcgcagatcatggaggtgaccgccaagtggctgtggggcttcctcagccgcaacaagaagccccggatctgcacgcgcgaggagttcacccggaaggtgcgctccaacgccgccatcggcgcggtcttcgtggacgagaaccagtggaacagcgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggtcccgggcgatctggtacatgtggctgggcgcccgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacgcggatcaccgaggacgacctgcagaacgaggcgaagatcaccgacatcatggagccggagcacgccctcctggccaagagcatcttcaagctgacctaccagaacaaggtcgtgcgcgtgcagcgccccgccaagaacgggacggtcatggacgtgatctcccggcgcgaccagcggggcagcggccaggtgggcacctacggcctcaacaccttcaccaacatggaggcccagctgatccgccagatggagtccgaggggatcttcagcccctccgagctggagacgcccaacctcgcgggccgggtcctggactggctggagaagcacggggtggagcgcctcaagcggatggccatcagcggcgacgactgcgtggtcaagccgatcgacgaccgcttcgccaccgccctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtcgtgccgtgccggaaccaggacgagctggtggggcgcgcgcgggtcagccagggcgccgggtggtccctgcgcgagaccgcctgcctcggcaagagctacgcccagatgtggcagctgatgtacttccaccggcgcgacctgcggctcgcggccaacgccatctgctccgccgtgcccgtggactgggtccccacgagccgcaccacctggtccatccacgcccaccaccagtggatgaccacggaggacatgctgagcgtgtggaaccgggtgtggatcgaggagaacccctggatggaggacaagacccacgtctccagctggggcgacgtgccgtacctgggcaagcgcgaggaccagtggtgcggctccctcatcgggctgaccgcgcgcgccacctgggccacgaacatccaggtggccatcaaccaggtccggcgcctgctcggcaacgagaactacctggactacatgaccagcatgaagcggttcaagaacgagtccgaccccgagggggccctgtggtga

SEQ ID NO: 8601 - RNA, 9879 nt, synthetic construct
  misc_feature 1..9879: note = derived and/or modified CDS sequence (opt1) from DENV-1__FJ898431__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgctgttcctgctcatcatggggcagctgacgtggaacgacctgatccggctctgcatcatggtcggcgcgaacgcctccgaccgcatggggatgggcaccacctacctggccctgatggccaccttcaagatgcgcccgatgttcgccgtgggcctcctgttccggcgcctgacgagccgggaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccaccctgctgtccctcacgttcatcaagaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgggacgacaccctgaccatcctcctgaaggccaccctgctcgccgtgagcggcgtgtacccgctgtccatccccgccacgctgttcgtctggtacttctggcagaagaagaagcagcgcagcggggtgctctgggacacccccagcccgcccgaggtggagcgggccgtcctggacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacacgggggaggaggtgcaggtcatcgccgtggagcccggcaagaaccccaagaacgtgcagaccgcccccgggaccttcaagacctccgagggcgaggtcggcgccatcgcgctggacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctcccggagatcgaggacgaggtcttccggaagcgcaacctgacgatcatggacctgcaccccggcagcgggaagacccggcgctacctccccgccatcgtgcgggaggccatcaagcgcaagctgcggaccctgatcctcgccccgacccgcgtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagaccttcgacacggagtaccagaagaccaagaacaacgactgggactacgtggtcaccaccgacatcagcgagatgggcgcgaacttccgcgccgaccgggtgatcgacccccgccggtgcctgaagccggtgatcctgaaggacgggcccgagcgcgtcatcctcgccggccccatgcccgtgacggtcgcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcacccccatgatgcgccacaccatcgagaacacgaccgccaacatcagcctcaccgccatcgcgaaccaggccgccatcctgatggggctggacaagggctggccgatctccaagatggacatcggcgtccccctcctggccctggggtgctacagccaggtgaaccccctcaccctgacggcggccgtgctgatgctcgtcgcccactacgccatcatcggccccgggctgcaggccaaggcgacccgggaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtcccccggcaagttctggaacaccacgatcgccgtgagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccaccatcgaggagggccgcacgctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggaccggcaacatcgtcagcgcggtgaacatgacctcccgcatgctgctcaaccggttcacgatggcccaccgcaagccgacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctcctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctctcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgcgctcctggccaagtccatcttcaagctgacctaccagaacaaggtggtccgcgtgcagcggccggccaagaacgggaccgtgatggacgtcatcagccgccgcgaccagcggggctccggccaggtgggcacctacggcctcaacacgttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccaccgccctgacggccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccctacctgggcaagcgcgaggaccagtggtgcggcagcctcatcgggctgacggcccgggcgacctgggccaccaacatccaggtcgccatcaaccaggtgcgccgcctgatcggcaacgagaactacctcgactacatgacctccatgaagcggttcaagaacgagagcgacccggagggggccctgtggtga

SEQ ID NO: 8602 - RNA, 9879 nt, synthetic construct
  misc_feature 1..9879: note = derived and/or modified CDS sequence (opt1) from DENV-1__GU131678__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcatgaccaagctggagggcaagatcgtgcagtacgagaacctcaagtacagcgtcatcgtgaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtccacaagcagtggttcctggacctcccgctgccctggaccagcggggccagcacctcccaggagacgtggaaccggcaggacctgctcgtgaccttcaagaccgcccacgcgaagaagcaggaggtggtcgtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcaaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggtgcaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcctggaacatctgggaggtcgaggactacggcttcgggatcttcaccaccaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtggtcgtggacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtcaaggagaaggaggagaacctcgtcaagagcatggtgagcgccggctccggcgaggtcgacagcttcctgctggggctcctgtgcatctccatcatgatcgaggaggtgatgcggagccgctggtcccggaagatgctgatgaccggcaccctcgccgtgttcttcctgctgatcatggggcagctcacctggaacgacctgatccgcctgtgcatcatggtcggcgccaacgcgagcgaccgcatggggatgggcacgacctacctcgccctgatggccaccttcaagatgcggccgatgttcgccgtggggctcctgttccgccggctgacctcccgcgaggtgctgctcctgacgatcgggctgagcctcgtcgcctccgtggagctgcccaacagcctggaggagctcggcgacgggctggcgatgggcatcatgatcctgaagctcctgaccgacttccagtcctaccagctgtgggccaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgcggagaacaagatctggggccggaagtcctggcccctgaacgaggggatcatggccgtcggcatcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggacgatgaagatcaaggacgaggagcgcgacgacaccctgaccatcctgctcaaggcgaccctgctggccgtgtccggcgtgtacccgctcagcatccccgccaccctgttcgtctggcacttctggcagaagaagaagcagcggtccggggtgctgtgggacacgcccagcccgcccgaggtggagcgcgccgtcctggacgacggcatctaccggatcatgcagcgcggcctcctggggcggtcccaggtgggcgtgggggtcttccaggagaacgtgttccacaccatgtggcacgtgacccgcggcgccgtcctgatgtaccaggggaagcggctcgagcccagctgggcgtccgtgaagaaggacctgatcagctacggcggcgggtggcgcttccagggctcctggaacaccggggaggaggtgcaggtcatcgccgtggagcccggcaagaaccccaagaacgtgcagacggcccccgggaccttcaagacccccgagggcgaggtcggcgccatcgccctggacttcaagcccgggaccagcggctcccccatcgtgaaccgggaggggaagatcgtgggcctctacggcaacggggtcgtgacgaccagcggcacctacgtgagcgcgatcgcccaggccaaggcctcccaggaggggccgctgcccgagatcgaggacgaggtcttccgcaagcggaacctgaccatcatggacctccaccccggcagcgggaagacgcgccggtacctgccggcgatcgtgcgcgaggccatcaagcggaagctgcgcaccctcatcctggcccccacccgcgtggtcgcctccgagatggccgaggcgctgaagggcatgcccatccggtaccagaccacggccgtcaagagcgagcacaccggcaaggagatcgtggacctcatgtgccacgccaccttcaccatgcgcctgctgtcccccgtccgggtgccgaactacaacatgatcatcatggacgaggcccacttcacggaccccagctccatcgccgcgcgcgggtacatcagcacccgggtgggcatgggggaggccgccgccatcttcatgaccgccacgccgcccggctccatggaggcgttcccgcagagcaacgccgtcatccaggacgaggagcgcgacatccccgagcggtcctggaacagcgggtacgagtggatcacggacttccccggcaagaccgtgtggttcgtgccctccatcaaggccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgcgaacttccgggccgaccgcgtcatcgacccgcggcgctgcctgaagcccgtgatcctcaaggacgggcccgagcgggtgatcctggccggccccatgccggtcaccgtggccagcgccgcgcagcgccgggggcgcatcggccggaaccccaacaaggagggcgaccagtacatctacatggggcagcccctgaacaacgacgaggaccacgcccactggacggaggccaagatgctcctggacaacatcaacacccccgagggcatcatcccggccctgttcgagcccgagcgcgagaagtccgccgcgatcgacggggagtaccgcctccggggcgaggcccgcaagaccttcgtcgagctgatgcggcgcggggacctgcccgtgtggctcagctacaaggtggcctccgagggcttccagtacagcgaccggcgctggtgcttcgccggcgagcggaacaaccaggtcctggaggagaacatggacgtggagatctggaccaaggagggggagcgcaagaagctgctcccccggtggctggacgcccgcacgtacagcgacccgctggcgctccgggagttcaaggagttcgccgccggccgccggtccgtgagcggggacctgatcctggagatcggcaagctcccccagcacctgacccagcgcgcccagaacgcgctggacaacctcgtcatgctgcacaactccgagcagggcgggcgggcctaccgccacgccatggaggagctgcccgacaccatcgagaccctcatgctgctggccctcatcgccgtgctgacgggcggggtgaccctgttcttcctcagcggcaaggggctgggcaagacctccatcggcctgctctgcgtcatggcgagctccgtgctgctgtggatggggagcgtggagccccactggatcgccgcctccatcatcctcgagttcttcctgatggtcctgctcatcccggagcccgaccggcagcgcacgccccaggacaaccagctggcctacgtggtgatcggcctcctgttcatgatcctgaccgtcgccgcgaacgagatggggctgctcgagacgaccaagaaggacctgggcatcgggcacgtggccgtggagaaccaccaccacgccgccatgctggacgtcgacctccacccggccagcgcgtggaccctgtacgccgtggccaccacgatcatcacccccatgatgcggcacaccatcgagaacaccacggccaacatctccctgaccgccatcgcgaaccaggccgccatcctcatgggcctggccaagggctggcccatcagcaagatggacatcggggtgcccctgctcgcgctgggctgctactcccaggtcaacccgctgaccctcaccgccgccgtgctgatgctggtggcccactacgccatcatcgggcccggcctccaggcgaaggccacgcgcgaggcccagaagcggaccgccgccgggatcatgaagaaccccaccatcgacggcatcgtcgcgatcgacctggaccccgtggtgtacgacgccaagttcgagaagcagctgggccagatcatgctcctgatcctgtgcaccagccagatcctcctgatgcgcacgacctgggccctgtgcgagtccatcaccctcgccaccgggccgctgacgaccctgtgggagggcagccccgggaagttctggaacaccaccatcgccgtctccatggcgaacatcttccgcggcagctacctcgccggcgccgggctggccttctccctgatgaagtccctcggcgggggccggcgcgggacgggcgcgcagggcgagaccctgggggagaagtggaagcggcagctgaaccagctcagcaagtccgagttcaacacctacaagcgcagcggcatcatggaggtggaccggtccgaggccaaggaggggctgaagcgcggcgagaccacgaagcacgccgtgagccgggggcccgccaagctgcgctggttcgtcgagcggaccctggtgaaccccgagggcaaggtgatcgccctcggctgcgggcgcggcgcgtggtcctactactgcgccgggctgaagaagggcaccgaggtcaaggggtacaccaagggcggcccggggcacgaggagcccatccccatggccacgtacggctgggacctggtgaagctccacagcgggaaggacgtgttcttcatcccgcccgagaagtgcgacaccctgctgtgcgacatcggcgagtccagccccaaccccaccatcgaggaggggcggaccctccgcgtcctgaagatggtggagccctggctgcggggcaaccagttctgcatcaagatcctcaacccctacatgccctccgtggtcgagacgctggagcagatgcagcgcaagcacggcgggatgctggtgcggaaccccctcagccgcaactccacccacgagatgtactgggtgagctgcggcaccgggaacatcgtctccgccgtgaacatgaccagccggatgctgctgaaccgcttcaccatggcccaccggaagcccacgtacgagcgcgacgtggacctcggcgcgggcacccgccacgtcgccgtggacccggaggtggccaacctggacatcatcgggcagcggatcgagaacatcaagcacgagcacaagtccacctggcactacgacgaggacaacccctacaagacctgggcctaccacggcagctacgaggtcaagccctccgggagcgcctccagcatggtgaacggcgtggtcaagctgctcacgaagccctgggacgtgatcccgatggtcacccagatcgcgatgaccgacaccacgcccttcgggcagcagcgcgtgttcaaggagaaggtggacacccggacccccaaggccaagcgcggcaccgcccagatcatggaggtcacggcccggtggctgtggggcttcctgagccgcaacaagaagccgcggatctgcacccgcgaggagttcacccggaaggtgcgctccaacgcggccatcggggccgtgttcgtcgacgagaaccagtggaacagcgccaaggaggccgtggaggacgaccggttctgggacctcgtgcaccgcgagcgggagctgcacaagcagggcaagtgcccgacctgcgtctacaacatgatggggaagcgcgagaagaagctgggcgagttcgggaaggcgaagggctcccggcccatctggtacatgtggctcggcgcccgcttcctggagttcgaggccctggggttcatgaacgaggaccactggttcagccgggagaactccctcagcggcgtggagggggaggccctgcacaagctgggctacatcctccgcgacatctccaagatccccgggggcaacatgtacgccgacgacacggcgggctgggacacccggatcaccgaggacgacctgcagaacgaggggaagatcaccgacatcatggagccggagcacgccctgctcgccaagagcatcttcaagctgacgtaccagaacaaggtggtccgcgtgcagcggcccgccaagaacggcaccgtgatggacgtcatctcccgccgcgaccagcgggggagcggccaggtgggcacctacgggctgaacaccttcacgaacatggaggcccagctcatccgccagatggagtccgagggcatcttcctgcccaacgagctggagacccccaacctcgcggggcgggtgctggactggctggagaagtacggcgtcgagcgcctcaagcggatggccatcagcggggacgactgcgtggtgaagccgatcgacgaccgcttcgccaccgccctgaccgccctgaacgacatgggcaaggtccggaaggacatcccccagtgggagccctccaagggctggaacgactggcagcaggtccccttctgcagccaccacttccaccagctcatcatgaaggacgggcgcgagatcgtggtcccgtgccggaaccaggacgagctggtgggccgcgcgcgggtgtcccagggggccggctggacgctgcgcgagaccgcctgcctcggcaagagctacgcccagatgtggcagctgatgtacttcccccggcgcgcgctgcggctcgccgccaacgccatctgctccgccgtccccgtggactgggtgcccaccagccgcaccacgtggagcatccacgcgcaccaccagtggatgaccaccgaggacatgctgtccgtctggaaccgggtgtggatcgaggagaacccgtggatggaggacaagacccgcatcagctcctgggaggacgtgccctacctgggcaagcgggaggaccagtggtgcggcagcctcatcgggctgacgccccgcgccacctggcccaccaacatccaggtcgccatcaaccaggtgcgccggctgatcggcaacgagaactactccgactacatgaccagcatgaagcgcttcaagaacgagtccgagccggagggggccctctggtga

SEQ ID NO: 8603 - RNA, 9879 nt, synthetic construct
  misc_feature 1..9879: note = derived and/or modified CDS sequence (opt1) from DENV-1__GU131679__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcggcgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgggagctgaagtgcgggagcggcatcttcgtgacgaacgaggtgcacacctggaccgagcagtacaagttccaggccgacagcccgaagcgcctctccgccgccatcggcaaggcctgggaggagggggtctgcggcatccggagcgcgacccgcctggagaacatcatgtggaagcagatctccaacgagctgaaccacatcctcctggagaacgacatgaagttcaccgtggtggtcggggacgtggccggcatcctggcccaggggaagaagatgatccggccccagcccatggagtacaagtacagctggaagtcctggggcaaggccaagatcatcggcgcggacgtgcagaacgccacgttcatcatcgacgggcccaacaccccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacctggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcgacctctgcgagggcaccaccgtggtcgtggacgagcactgcggcaaccgggggccgtccctgcgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctggtgaagtccatggtgagcgcgggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacctggaacgacctgatccggctgtgcatcatggtcggcgccaacgccagcgaccgcatggggatgggcacgacgtacctcgccctgatggcgaccttcaagatgcgcccgatgttcgccgtggggctcctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggcgaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggacgatgaagatcaaggacgaggagcgggacgacatgctgaccatcctgctcaaggccaccctgctggccgtgtccggcgtgtacccgctcagcatccccgcgaccctgttcgtctggtacttctggcagaagaagaagcagcgctccggggtgctgtgggacaccccctccccgcccgaggtggagcgggccgtcctcgacgacggcatctaccgcatcatgcagcggggcctgctggggcgctcccaggtgggcgtgggggtcttccaggagaacgtgttccacacgatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagaccgcgcccgggacgttcaagaccagcgagggcgaggtcggcgccatcgccctcgacttcaagcccgggacctccggcagccccatcgtgaaccgcgaggggaagatcgtgggcctgtacggcaacggggtcgtgaccacgagcggcacctacgtgtccgccatcgcgcaggccaaggccagccaggaggggcccctgccggagatcgaggacgaggtcttccggaagcgcaacctcaccatcatggacctgcaccccggctccgggaagacccggcgctacctgcccgccatcgtgcgggaggccatcaagcgcaagctccggacgctgatcctggcgccgacccgcgtggtcgccagcgagatggccgaggccctcaagggcatgcccatccgctaccagaccaccgccgtgaagtccgagcacacgggcaaggagatcgtggacctgatgtgccacgcgaccttcaccatgcggctgctcagccccgtccgcgtgcccaactacaacatgatcatcatggacgaggcccacttcaccgacccgtccagcatcgccgcccgggggtacatctccacgcgcgtgggcatgggggaggccgcggccatcttcatgaccgccacgccgcccggcagcgtcgaggccttcccccagtccaacgcggtgatccaggacgaggagcgggacatcccggagcgcagctggaactccgggtacgagtggatcaccgacttccccggcaagacggtgtggttcgtccccagcatcaagtccggcaacgacatcgccaactgcctgcggaagaacgggaagcgcgtgatccagctgagccggaagaccttcgacaccgagtaccagaagaccaagaacaacgactgggactacgtggtcacgaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgcgagcgccgcccagcggcgcgggcggatcggccgcaaccacaacaaggagggcgaccagtacatctacatggggcagccgctcaacaacgacgaggaccacgcccactggaccgaggccaagatgctgctggacaacatcaacacgcccgagggcatcatccccgccctcttcgagcccgagcgggagaagtccgccgccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcgcgcacctacagcgaccccctggccctccgggagttcaaggagttcgccgccggccgccggtccgtcagcggggacctgatcctggagatcggcaagctcccccagcacctgacgcagcgcgcgcagaacgccctggacaacctcgtgatgctgcacaactccgagcagggcgggcgggcctaccgccacgccatggaggagctgccggacaccatcgagaccctcatgctgctggccctcatcgcggtgctgaccggcggggtcacgctgttcttcctcagcggccgggggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccgccagcggaccccgcaggacaaccagctggcgtacgtggtcatcgggctcctcttcatgatcctgaccgtggccgccaacgagatgggcctgctcgagaccacgaagaaggacctggggatcggccacgtggccgtcgagaaccaccaccacgccgcgatgctggacgtggacctccaccccgccagcgcctggaccctgtacgccgtggccaccaccatcatcacgcccatgatgcgccacaccatcgagaacaccaccgcgaacatctccctgacggccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacccgggaggcccagaagcgcacggccgcgggcatcatgaagaacccgaccgtggacgggatcgtggccatcgagctggaccccgtcgtgtacgacaccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccaccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtcgccatcaaccaggtgcgccgcctgatcggcaacgagaactacctggactacatgaccagcatgaagcggttcaagaacgagatcgacccggagggggccctctggtga

SEQ ID NO: 8604 - RNA, 9879 nt, synthetic construct
  misc_feature 1..9879: note = derived and/or modified CDS sequence (opt1) from DENV-1__GU131680__SS-prME
  source 1..9879: mol_type = other RNA
agcgtgaccatgctgctgatgctgatgcccaccgccctggccttccacctcaccacccggggcggggagccccacatggtggtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctcgcgccccacgtcggcctggggctggagacgcggaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcggtgctgcggaagctctgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcctgacgtgcgccaagttcaagtgcgtcaccaagctggagggcaagatcgtgcagtacgagaacctcaagtacagcgtgatcgtcaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtgcacaagcagtggttcctggacctccccctgccctggaccagcggggccagcacctcccaggagacgtggaaccggcaggacctgctcgtcaccttcaagaccgcccacgcgaagaagcaggaggtggtggtcctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggccgactccgggtgcgtgatcaactggaagggccgggagctgaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtggtcgtgggggacgtggcgggcatcctggtccaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcctggaacatctgggaggtggaggactacggcttcgggatcttcaccaccaacatctggctgaagctccgggactcctacacgcaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacctgcatctggcccaagagccacaccctctggtccaacggcgtcctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtggtggtcgacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtgaaggagaaggaggagaacctcgtcaagagcatggtgagcgccggctccggcgaggtggacagcttctccctggggctgctctgcatcagcatcatgatcgaggaggtcatgcggtcccgctggagccggaagatgctgatgaccggcaccctggccgtgttcttcctcctgatcatggggcagctgacctggaacgacctcatccgcctgtgcatcatggtgggcgccaacgcgtccgaccgcatggggatgggcacgacctacctggccctcatggccaccttcaagatgcggccgatgttcgccgtcggcctgctgttccgccggctcaccagccgcgaggtgctgctgctcacgatcgggctgtccctggtcgccagcgtggagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtcagcctgttccccctgtgcctctccaccacgagccagaagaccacctggctgcccgtgctgctcggctccctggggtgcaagccgctgaccatgttcctcatcgcggagaacaagatctggggccggaagtcctggcccctgaacgaggggatcatggccgtgggcatcgtcagcatcctgctctccagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggacgatgaagatcaaggacgaggagcgcgacgacaccctcaccatcctgctgaaggcgaccctcctggccgtcagcggcgtgtacccgctgtccatccccgccaccctcttcgtgtggcacttctggcagaagaagaagcagcggagcggggtcctgtgggacacgcccagcccgcccgaggtggagcgcgccgtgctggacgacggcatctaccggatcatgcagcgcggcctgctcgggcggagccaggtcggcgtgggggtgttccaggagaacgtcttccacaccatgtggcacgtgacccgcggcgccgtgctgatgtaccaggggaagcggctggagccctcctgggcgagcgtcaagaaggacctcatctcctacggcggcgggtggcgcttccagggcagctggaacaccggggaggaggtccaggtgatcgccgtcgagcccggcaagaaccccaagaacgtgcagacggcccccgggaccttcaagacccccgagggcgaggtgggcgccatcgccctggacttcaagcccgggacctccggcagccccatcgtcaaccgggaggggaagatcgtgggcctgtacggcaacggggtggtcacgaccagcggcacctacgtgtccgcgatcgcccaggccaaggccagccaggaggggccgctccccgagatcgaggacgaggtgttccgcaagcggaacctgaccatcatggacctgcaccccggctccgggaagacgcgccggtacctcccggcgatcgtccgcgaggccatcaagcggaagctgcgcaccctgatcctcgcccccacccgcgtggtggccagcgagatggccgaggcgctgaagggcatgcccatccggtaccagaccacggccgtcaagtccgagcacaccggcaaggagatcgtggacctgatgtgccacgccaccttcaccatgcgcctcctgagccccgtgcgggtcccgaactacaacatgatcatcatggacgaggcccacttcacggacccctccagcatcgccgcgcgcgggtacatctccacccgggtgggcatgggggaggccgccgccatcttcatgaccgccacgccgcccggcagcatggaggcgttcccgcagtccaacgccgtgatccaggacgaggagcgcgacatccccgagcggagctggaactccgggtacgagtggatcacggacttccccggcaagaccgtctggttcgtgcccagcatcaaggccggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgcgaacttccgggccgaccgcgtgatcgacccgcggcgctgcctgaagcccgtcatcctgaaggacgggcccgagcgggtgatcctcgccggccccatgccggtcaccgtggcctccgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtctggctgtcctacaaggtggccagcgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtcctgacgggcggggtgaccctcttcttcctgtccggcaaggggctgggcaagaccagcatcggcctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgaccgtggccgcgaacgagatgggcctcctggagacgaccaagaaggacctggggatcggccacgtcgccgtggagaaccaccaccacgccgccatgctcgacgtggacctgcaccccgcctccgcgtggaccctgtacgccgtcgccaccacgatcatcaccccgatgatgcgccacaccatcgagaacaccacggccaacatcagcctcaccgccatcgcgaaccaggccgccatcctgatggggctggacaagggctggcccatctccaagatggacatcggcgtgcccctcctggccctggggtgctacagccaggtgaaccccctcaccctgaccgcggccgtcctgatgctcgtggcccactacgccatcatcggcccggggctgcaggccaaggcgacgcgggaggcccagaagcgcaccgccgccggcatcatgaagaaccccaccatcgacgggatcgtggccatcgacctggaccccgtcgtgtacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggccaacatcttccgggggtcctacctggcgggcgccggcctggccttcagcctcatgaagtccctcgggggcgggcgccgggggacgggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagaccacgaagcacgccgtgtcccgcggcaccgccaagctccggtggttcgtggagcgcaacctggtcaagcccgaggggaaggtgatcgacctgggctgcggccgcgggggctggagctactactgcgccgggctgaagaaggtgaccgaggtcaagggctacaccaagggcggccccggccacgaggagcccatcccgatggccacgtacgggtggaacctcgtgaagctgcactccggcaaggacgtgttcttcatcccgcccgagaagtgcgacaccctgctctgcgacatcggggagagctcccccaacccgaccatcgaggagggccgcaccctgcgggtcctgaagatggtggagccctggctccgcgggaaccagttctgcatcaagatcctgaacccctacatgcccagcgtggtcgagacgctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccggttcaccatggcccaccgcaagcccacgtacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctcctgacgaagccctgggacgtgatccccatggtcacccagatcgccatgaccgacaccacgcccttcggccagcagcgggtgttcaaggagaaggtggacacccgcaccccgaaggccaagcgggggaccgcccagatcatggaggtcacggcgcgctggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgaccgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagccggagcacgcgctcctggccaagtccatcttcaagctgacgtaccagaacaaggtggtccgggtgcagcgccccgccaagaacgggaccgtgatggacgtcatcagccgccgggaccagcgcggctccggccaggtggggacctacggcctcaacaccttcacgaacatggaggcccagctgatccggcagatggagagcgaggggatcttcctgcccaacgagctcgagacccccaacctggccggccgcgtgctggactggctcgagaagtacggggtcgagcggctgaagcgcatggcgatctccggcgacgactgcgtggtgaagccgatcgacgaccggttcgccaccgccctgaccgccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgcggggtggtccctccgggagacggcctgcctgggcaagagctacgcccagatgtggcagctgatgtacttccaccgccgggacctccgcctggccgcgaacgccatctgcagcgccgtccccgtggactgggtgcccacctcccggaccacctggagcatccacgcccaccaccagtggatgacgaccgaggacatgctgtccgtctggaaccgcgtgtggatcgaggagaacccctggatggaggacaagacccggatcagctcctgggaggacgtgccgtacctcgggaagcgcgaggaccagtggtgcggcagcctgatcggcctgaccgcccgcgcgacgtgggccaccaacatccaggtcgccatcaaccaggtgcggcgcctcatcgggaacgagaactactccgactacatgaccagcatgaagcggttcaagaacgagtccgagcccgagggcgccctgtggtga

SEQ ID NO: 8605 - RNA, 9879 nt, synthetic construct
  misc_feature 1..9879: note = derived and/or modified CDS sequence (opt1) from DENV-1__GU131681__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaaggtgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgaccctgctggccgtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtccgggaggccatcaagcgcaagctccggaccctgatcctggcccccacccgcgtggtggcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgcggaccgggtcatcgacccgcgccggtgcctcaagcccgtgatcctgaaggacgggcccgagcgcgtcatcctggccggccccatgccggtgacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacaccatcgagacgctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggcggtggagaaccaccaccacgccaccatgctggacgtcgacctccaccccgcctccgcctggacgctgtacgccgtggcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtcaaccccctgacgctcaccgccgccgtgctgatgctggtggcgcactacgccatcatcggcccggggctccaggccaaggccacccgggaggcccagaagcgcaccgcggccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacacgaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgacgatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacgtcccggatgctgctgaaccgcttcaccatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacccagatcgcgatgacggacaccacccccttcggccagcagcgcgtcttcaaggagaaggtggacacccggacgccgaaggccaagcgcgggaccgcccagatcatggaggtgaccgcccggtggctgtggggcttcctgtcccgcaacaagaagccccggatctgcacccgcgaggagttcacgcggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtggtgcgggtccagcgccccgcgaagaacgggacggtgatggacgtgatcagccgccgggaccagcgcggctccgggcaggtcggcacctacggcctgaacaccttcaccaacatgggggcccagctcatccggcagatggagagcgagggcatcttctcccccagcgagctggagatccccaacctggccgagcgcgtgctcgactggctggagaagtacggggtggagcggctgaagcgcatggccatctccggcgacgactgcgtcgtgaagccgatcgacgaccggttcgccacggcgctcaccgccctgaacgacatggggaaggtgcgcaaggacgtcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgccgggtggagcctgcgggagaccgcctgcctgggcaagtcctacgcgcagatgtggcagctcatgtacttccaccgccgggacctgcgcctggccgccaacgccatctgcagcgcggtccccgtggactgggtgcccacctcccggacgacctggagcatccacgcccaccaccagtggatgaccaccgaggacatgctctccgtctggaaccgcgtgtggatcgaggagaacccctggatggaggacaagacgcacgtgagctcctggggcgacgtcccgtacctgggcaagcgggaggaccagtggtgcggcagcctgatcgggctcaccgcccgcgccacctgggcctccaacatccaggtggcgatcaaccaggtgcgccggctgatcggcaacgagaactacctggactacatgaccagcatgaagcgcttcaagaacgagggggaccccgagggcgccctctggtga

SEQ ID NO: 8606 - RNA, 9879 nt, synthetic construct
  misc_feature 1..9879: note = derived and/or modified CDS sequence (opt1) from DENV-1__GU131682__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcatcatcggcgccggcgagaaggccctgaagctcagctggttcaagaaggggtccagcatcggcaagatgttcgaggcgacggcccgcggggcccggcgcatggccatcctgggcgacaccgcctgggacttcgggtccatcggcggcgtgttcaccagcgtcgggaagctggtgcaccagatcttcggcaccgcgtacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcccaggggaagaagatgatccggccccagcccatggagcacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgccagcgaccgcatggggatgggcaccacctacctggcgctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggccatgggcatcatgatcctcaagctgctgaccgacttccagtcccaccagctctgggcgacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgccgagaacaagatctggggccggcgctcctggcccctcaacgaggggatcatggcggtcggcatcgtgagcatcctgctgagctccctcctgaagaacgacgtgcccctggccgggcccctcatcgccggcggcatgctgatcgcctgctacgtcatcagcgggtccagcgccgacctgtccctcgagaaggcggccgaggtgagctgggaggaggaggccgagcactccggcgccagccacaacatcctggtggaggtccaggacgacgggaccatgaagatcaaggacgaggagcgggacgacaccctgaccatcctcctgaaggccacgctgctcgcggtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcctccgtgaagaaggacctgatcagctacggcggcgggtggcggctccagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgccatcgcgcaggccaaggcctcccaggaggggccgctccccgagatcgaggacgaggtcttccggaagcgcaacctgaccatcatggacctgcaccccggcagcgggaagacccggcgctacctcccggccatcgtgcgggaggcgatcaagcgcaagctgcgcaccctgatcctcgcccccacgcgggtggtcgcctccgagatggccgaggccctgaagggcatgcccatccgctaccagaccaccgcggtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcccgggggtacatcagcacccgcgtgggcatgggggaggcggccgccatcttcatgacggccacgccgcccggctccgtcgaggccttcccgcagagcaacgcggtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgccgaccgggtgatcgacccgcgccggtgcctgaagcccgtgatcctgaaggacgggcccgagcgcgtcatcctcgcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgcgagaagtccgccgccatcgacggggagtaccggctgcgcggcgaggcccggaagacgttcgtggagctcatgcgccgcggggacctgcccgtgtggctgtcctacaaggtcgcgagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgccggccgccggagcgtctccggggacctgatcctcgagatcggcaagctgccgcagcacctgacccagcgcgcgcagaacgccctcgacaacctggtgatgctgcacaacagcgagcagggcgggcgggcctaccgccacgccatggaggagctccccgacacgatcgagaccctgatgctgctcgcgctgatcgccgtgctgaccggcggggtcaccctcttcttcctgtccggccgggggctgggcaagaccagcatcggcctcctgtgcgtgatggcctccagcgtgctgctctggatggcctccgtcgagccccactggatcgccgcgagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggccgtcgagaaccaccaccacgcggccatgctcgacgtggacctgcaccccgcctccgcctggacgctgtacgccgtggcgaccaccatcatcaccccgatgatgcgccacacgatcgagaacaccaccgccaacatcagcctcaccgccatcgccaaccaggccgcgatcctgatggggctggacaagggctggcccatctccaagatggacatcggcgtccccctcctggccctggggtgctacagccaggtgaaccccctcacgctgaccgccgccgtgctgatgctcgtcgcgcactacgccatcatcggcccggggctgcaggccaaggccacccgcgaggcccagaagcggaccgcggccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggccctctgcgagagcatcacgctggcgaccggccccctgaccaccctctgggaggggtccccgggcaagttctggaacacgaccatcgccgtgagcatggccaacatcttccgggggtcctacctggccggcgccggcctggcgttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgccgtgtcccgcggcaccgcgaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcccaccggaagcccacctacgagcgcgacgtggacctgggggcgggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctcctgaccaagccctgggacgtgatccccatggtcacccagatcgcgatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgcggacgacaccgccggctgggacacccggatcacggaggacgacctgcagaacgaggcccgcatcaccgacatcatggagccggagcacgccctcctggccaagtccatcttcaagctgacctaccagaacaaggtggtccgcgtgcagcggcccgcgaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtgctggactggctggagaagtacggcgtcgagcggctcaagcgcatggccatctccggggacgactgcgtggtgaagccgatcgacgaccggttcgccacggcgctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgcgaggaccagtggtgcggcagcctcatcggcctgaccgcccgggccacctgggccaccaacatccaggtggcgatcaaccaggtccgccggctgatcgggaacgagaactacctcgactacatgacctccatgaagcgcttcaagaacgagagcgaccccgagggcgccctgtggtga

SEQ ID NO: 8607 - RNA, 9879 nt, synthetic construct
  misc_feature 1..9879: note = derived and/or modified CDS sequence (opt1) from DENV-1__GU131683__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacccccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggagcgtggccctcgccccgcacgtgggcctggggctggagacccgcaccgagacctggatgagcagcgagggcgcgtggaagcagatccagcgggtcgagacgtgggccctccggcaccccgggttcaccgtgatcgccctgttcctggcccacgcgatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaacccggccgtgctgcggaagctctgcatcgaggcgaagatcagcaacaccacgaccgactcccgctgccccacccagggcgaggccaccctggtggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccaccaccgagatccagctcaccgactacggggccctgacgctggactgctccccgcgcaccggcctcgacttcaacgagatggtcctgctgaccatgaaggagaagtcctggctcgcccacaagcagtggttcctggacctgcccctcccctggacctccggggccagcacgagccaggagacctggaaccggcaggacctgctggtgaccttcaagaccgcccacgcgaagaagcaggaggtggtcgtgctcggctcccaggagggcgccatgcacacggccctgaccggggccaccgagatccagaccagcggcacgaccaccatcttcgccgggcacctgaagtgccgcctcaagatggacaagctgaccctgaagggcatgtcctacgtgatgtgcacggggagcttcaagctcgagaaggagctggcggagacccagcacggcaccgtcctggtgcagatcaagtacgagggcaccgacgccccctgcaagatcccgttctccacgcaggacgagaagggggtgacccagaacggccggctgatcaccgccaaccccatcgtcaccgacaaggagaagcccgtgaacatcgaggccgagcccccgttcggggagagctacatcgtgatcggcgcgggcgagaaggccctcaagctgtcctggttcaagaaggggagctccatcggcaagatgttcgaggccacggcccgcggggcccggcgcatggcgatcctgggcgacaccgcctgggacttcgggagcatcggcggcgtcttcacctccgccgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggcggacagcgggtgcgtcatcaactggaagggccgggagctgaagtgcgggtccggcatcttcgtgaccaacgaggtgcacacctggaccgagcagtacaagttccaggccgacagccccaagcgcctgagcgccgccatcggcaaggcctgggaggagggggtctgcggcatccggtccgcgacccgcctcgagaacatcatgtggaagcagatcagcaacgagctgaaccacatcctgctcgagaacgacatgaagttcacggtggtggtcggggacgtggccggcatcctggcccaggggaagaagatgatccggccccagcccatggagtacaagtactcctggaagtcctggggcaaggccaagatcatcggcgcggacgtgcagaacaccaccttcatcatcgacgggccgaacacccccgagtgccccgacgaccagcgcgcctggaacatctgggaggtcgaggactacggcttcgggatcttcacgaccaacatctggctgaagctccgggactcctacacccaggtgtgcgaccaccgcctgatgagcgccgccatcaaggactccaaggccgtgcacgcggacatgggctactggatcgagagcgagaagaacgagacctggaagctggcccgggccttcttcatcgaggtcaagacgtgcatctggcccaagtcccacaccctctggagcaacggcgtgctggagtccgagatgatcatcccgaagatctacgggggccccatcagccagcacaactaccgccccgggtacttcacccagaccgccggcccgtggcacctggggaagctcgagctggacttcgacctgtgcgagggcacgaccgtggtcgtggacgagcactgcggcaaccgggggccctccctccgcaccaccacggtgaccggcaagatcatccacgagtggtgctgccggagctgcaccctgccgcccctgcgcttccgcggggaggacggctgctggtacgggatggagatccgcccggtcaaggagaaggaggagaacctcgtgaagtccatggtgagcgccggctccggcgaggtcgacagcttcagcctggggctgctctgcatctccatcatgatcgaggaggtgatgcggagccgctggtcccggaagatgctgatgaccggcacgctggcggtgttcttcctcctgatcatggggcagctgacctggaacgacctcatccgcctgtgcatcatggtcggcgccaacgccagcgaccgcatggggatgggcaccacctacctggccctcatggccacgttcaagatgcggcccatgttcgcggtgggcctgctgttccgccggctcacctcccgcgaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcgtggaagacgatggccatggtgctcagcatcgtctccctgttccccctgtgcctcagcaccacctcccagaagaccacgtggctgccggtgctgctcggcagcctggggtgcaagcccctgaccatgttcctcatcgccgagaacaagatctggggccggcgctcctggcccctgaacgaggggatcatggccgtcggcatcgtgagcatcctgctctccagcctgctgaagaacgacgtgcccctcgccgggccgctgatcgcgggcggcatgctgatcgcctgctacgtcatcagcgggtccagcgccgacctctccctggagaaggccgccgaggtgagctgggaggaggaggcggagcactccggcgccagccacaacatcctggtggaggtccaggacgacgggaccatgaagatcaaggacgaggagcgggacgacaccctcaccatcctgctgaaggccacgctcctggccgtgtccggcgtgtaccccctgagcatccccgccaccctcttcgtctggtacttctggcagaagaagaagcagcgctccggggtgctgtgggacacccccagcccgcccgaggtggagcgggcggtcctggacgacggcatctaccgcatcatgcagcggggcctgctcgggcgctcccaggtgggcgtgggggtcttccaggagaacgtgttccacaccatgtggcacgtgacgcggggcgccgtcctgatgtaccaggggaagcgcctggagcccagctgggcctccgtgaagaaggacctcatcagctacggcggcgggtggcggctgcagggctcctggaacaccggggaggaggtgcaggtcatcgccgtggagcccggcaagaacccgaagaacgtgcagaccgcccccgggaccttcaagacgcccgagggcgaggtcggcgcgatcgccctggacttcaagcccgggaccagcggctccccgatcgtgaaccgcgaggggaagatcgtgggcctctacggcaacggggtcgtgaccaccagcggcacgtacgtgtccgccatcgcccaggcgaaggccagccaggaggggcccctgcccgagatcgaggacgaggtcttccggaagcgcaacctgaccatcatggacctccacccgggcagcgggaagacccggcgctacctgcccgccatcgtgcgggaggccatcaagcgcaagctgcgcaccctcatcctggcccccacgcgggtggtcgcgtccgagatggccgaggccctgaagggcatgcccatccgctaccagaccaccgccgtcaagagcgagcacaccggcaaggagatcgtggacctcatgtgccacgccacgttcaccatgcggctgctgtccccggtccgcgtgcccaactacaacatgatcatcatggacgaggcgcacttcaccgaccccagctccatcgccgcccgggggtacatcagcacccgcgtgggcatgggggaggccgccgcgatcttcatgacggccacgcccccgggctccgtcgaggccttcccccagagcaacgccgtgatccaggacgaggagcgggacatccccgagcgctcctggaacagcgggtacgagtggatcaccgacttccccggcaagaccgtgtggttcgtcccgtccatcaagagcggcaacgacatcgcgaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctcaaggacgggcccgagcgcgtcatcctggccggcccgatgcccgtgaccgtggcctccgcggcccagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatcccggccctgttcgagcccgagcgcgagaagtccgcggccatcgacggggagtaccggctccgcggcgaggcccggaagacgttcgtcgagctgatgcgccgcggggacctgcccgtgtggctctcctacaaggtcgccagcgagggcttccagtactccgaccgccggtggtgcttcgacggcgagcgcaacaaccaggtgctggaggagaacatggacgtggagatctggaccaaggagggggagcggaagaagctgcgcccccggtggctcgacgcccgcacctacagcgacccgctggcgctgcgggagttcaaggagttcgccgccggccgccggagcgtctccggggacctcatcctggagatcggcaagctgccccagcacctcacccagcgcgcccagaacgcgctggacaacctggtgatgctccacaacagcgagcagggcgggcgggcctaccgccacgccatggaggagctgcccgacacgatcgagaccctgatgctcctggccctgatcgccgtgctcaccggcggggtcaccctgttcttcctgtccggccgggggctcggcaagaccagcatcggcctgctgtgcgtgatggcgtccagcgtgctcctgtggatggcctccgtcgagccccactggatcgccgccagcatcatcctggagttcttcctcatggtgctgctgatcccggagcccgaccgccagcggacgccccaggacaaccagctcgcctacgtggtcatcgggctgctgttcatgatcctcaccgtggcggccaacgagatgggcctgctggagaccaccaagaaggacctcgggatcggccacgtggccgtcgagaaccaccaccacgccgccatgctggacgtggacctgcacccggcgtccgcctggacgctctacgccgtggccaccaccatcatcacccccatgatgcgccacacgatcgagaacaccaccgccaacatcagcctgaccgcgatcgccaaccaggccgccatcctgatggggctcgacaagggctggcccatctccaagatggacatcggcgtccccctgctggcgctcgggtgctacagccaggtgaacccgctgacgctgaccgccgccgtgctcatgctggtcgcccactacgccatcatcggccccgggctgcaggcgaaggccacccgcgaggcccagaagcggaccgccgccggcatcatgaagaaccccacggtggacgggatcgtggcgatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggccaccggcccgctcaccaccctgtgggaggggtcccccggcaagttctggaacacgaccatcgccgtgagcatggcgaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgagcaagagcgagttcaacacgtacaagcggtccgggatcatggaggtcgaccgcagcgaggccaaggagggcctcaagcgcggggagaccaccaagcacgccgtgtcccgcggcaccgccaagctgcggtggttcgtggagcgcaacctggtcaagcccgaggggaaggtgatcgacctgggctgcggccgcggcgggtggagctactactgcgccgggctcaagaaggtgacggaggtcaaggggtacaccaagggcggccccggccacgaggagccgatccccatggcgacctacgggtggaacctggtgaagctgcactccggcaaggacgtgttcttcatcccgcccgagaagtgcgacaccctcctgtgcgacatcggggagagctccccgaaccccacgatcgaggagggccgcaccctgcgggtcctcaagatggtggagccctggctgcgcgggaaccagttctgcatcaagatcctgaacccctacatgccgagcgtggtcgagaccctcgagcagatgcagcggaagcacggcggcatgctggtgcgcaaccccctgtcccggaacagcacccacgagatgtactgggtgtcctgcgggaccggcaacatcgtcagcgccgtgaacatgacgtcccgcatgctcctgaaccgcttcaccatggcccaccggaagcccacctacgagcgcgacgtggacctgggggccggcacccggcacgtcgccgtggagcccgaggtggcgaacctcgacatcatcggccagcgcatcgagaacatcaagcacgagcacaagagcacgtggcactacgacgaggacaacccgtacaagacctgggcctaccacgggtcctacgaggtcaagcccagcggctccgccagctccatggtgaacggggtggtcaagctgctgaccaagccctgggacgtgatccccatggtcacccagatcgccatgacggacaccaccccgttcggccagcagcgggtgttcaaggagaaggtggacacccgcacgcccaaggccaagcgggggaccgcgcagatcatggaggtcaccgccaagtggctctggggcttcctgagccgcaacaagaagccccggatctgcacccgcgaggagttcacgcggaaggtgcgcagcaacgccgccatcggcgcggtgttcgtcgacgagaaccagtggaactccgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcgcgcatcaccgacatcatggagcccgagcacgccctgctggccaagtccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagaccccgaacctggcggagcgcgtgctggactggctcgagaagtacggcgtcgagcggctgaagcgcatggccatctccggggacgactgcgtggtgaagcccatcgacgaccggttcgccacggccctgaccgccctcaacgacatgggcaaggtccgcaaggacatcccccagtgggagcccagcaaggggtggaacgactggcagcaggtcccgttctgctcccaccacttccaccagctgatcatgaaggacggccgggagatcgtggtcccctgccgcaaccaggacgagctggtgggccgggcgcgcgtgagccagggggccggctggtccctccgggagaccgcctgcctgggcaagagctacgcccagatgtggcagctgatgtacttccaccgccgggacctccgcctggcggccaacgccatctgcagcgccgtccccgtggactggatccccacctcccggacgacctggagcatccacgcccaccaccagtggatgaccaccgaggacatgctgtccgtgtggaaccgcgtctggatcgaggagaacccgtggatggaggacaagacgcacatcagctcctggggcgacgtgccctacctcgggaagcgcgaggaccagtggtgcggcagcctgatcggcctgaccgcgcgggccacctgggccaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8608 - RNA, 9879 nt, synthetic construct
  misc_feature 1..9879: note = derived and/or modified CDS sequence (opt1) from DENV-1__GU131684__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcaaggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtggggctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgtggtgtcctgggaggaggaggccgagcacagcggcgcgtcccacaacatcctggtcgaggtgcaggacgacgggacgatgaagatcaaggacgaggagcgcgacgacaccctgaccatcctcctgaaggccaccctgctcgccgtgagcggcgtctacccgctgtccatccccgccaccctgttcgtgtggtacttctggcagaagaagaagcagcggagcggggtgctctgggacacgcccagcccgcccgaggtcgagcgcgccgtgctggacgacggcatctaccggatcatgcagcgcggcctgctggggcggagccaggtgggcgtcggggtgttccaggagaacgtgttccacaccatgtggcacgtcacccgcggcgcggtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgggaggggaagatcgtcggcctgtacggcaacggggtggtgacgacctccggcacctacgtcagcgccatcgcccaggccaaggcgtcccaggaggggcccctcccggagatcgaggacgaggtgttccgcaagcggaacctgaccatcatggacctgcaccccggcagcgggaagacgcgccggtacctccccgccatcgtgcgcgaggccatcaagcggaagctgcgcaccctgatcctcgccccgacccgcgtcgtggcctccgagatggcggaggccctgaagggcatgcccatccggtaccagaccacggccgtcaagagcgagcacaccggcaaggagatcgtcgacctgatgtgccacgccaccttcaccatgcgcctcctgtcccccgtgcgggtgcccaactacaacatgatcatcatggacgaggcccacttcacggacccgagctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatcccggagcggtcctggaacagcgggtacgagtggatcacggacttccccggcaagaccgtctggttcgtgccctccatcaagagcggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgcgaacttccgggccgaccgcgtgatcgacccccggcgctgcctgaagccggtcatcctgaaggacgggcccgagcgggtgatcctcgccggccccatgcccgtcaccgtggcctccgccgcgcagcgccgggggcgcatcggccggaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtggagctcatgcggcgcggggacctgccggtctggctgagctacaaggtggcctccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgaccccctcgccctgcgcgagttcaaggagttcgcggccggccggcgcagcgtgtccggggacctgatcctcgagatcggcaagctgccccagcacctgacccagcgggcccagaacgccctcgacaacctggtgatgctgcacaacagcgagcagggcgggcgcgcgtaccggcacgccatggaggagctcccggacaccatcgagaccctgatgctgctcgccctgatcgccgtcctgacgggcggggtgaccctcttcttcctgtccggccgcgggctgggcaagaccagcatcggcctcctgtgcgtgatggcctccagcgtcctgctctggatggcgtccgtggagccccactggatcgccgccagcatcatcctggagttcttcctgatggtgctcctgatccccgagcccgaccggcagcgcaccccgcaggacaaccagctggcctacgtcgtgatcgggctcctgttcatgatcctgaccgtggccgcgaacgagatgggcctcctggagacgaccaagaaggacctggggatcggccacgtcgccgtggagaaccaccaccacgccgccatgctcgacgtggacctgcaccccgcctccgcgtggaccctgtacgccgtcgccaccacgatcatcacccccatgatgcggcacaccatcgagaacaccacggccaacatcagcctcaccgccatcgcgaaccaggccgccatcctgatggggctggacaagggctggccgatctccaagatggacatcggcgtgcccctcctggccctggggtgctacagccaggtgaaccccctcaccctgaccgcggccgtcctgatgctcgtggcccactacgccatcatcggccccgggctgcaggccaaggcgacgcgcgaggcccagaagcgcaccgccgccggcatcatgaagaacccgaccgtggacgggatcgtcgccatcgacctggaccccgtggtgtacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtcagcatggccaacatcttccgcgggagctacctggcgggcgccggcctggccttctccctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagaccacgaagcacgccgtgtcccggggcaccgccaagctccgctggttcgtcgagcggaacctggtgaagccggaggggaaggtgatcgacctgggctgcggccgcgggggctggagctactactgcgccgggctgaagaaggtcaccgaggtgaagggctacaccaagggcgggcccggccacgaggagcccatccccatggccacgtacgggtggaacctcgtgaagctgcactccggcaaggacgtcttcttcatcccgcccgagaagtgcgacaccctgctctgcgacatcggggagagctcccccaaccccaccatcgaggagggccggaccctgcgcgtgctgaagatggtggagccgtggctccgggggaaccagttctgcatcaagatcctgaacccctacatgcccagcgtcgtggagacgctggagcagatgcagcgcaagcacggcggcatgctcgtgcggaaccccctgtcccgcaacagcacccacgagatgtactgggtctcctgcgggaccggcaacatcgtgagcgcggtgaacatgacctcccggatgctgctcaaccgcttcaccatggcccaccgcaagccgacgtacgagcgggacgtcgacctgggggccggcacccgccacgtggccgtggagcccgaggtcgccaacctggacatcatcggccagcggatcgagaacatcaagcacgagcacaagagcacctggcactacgacgaggacaacccctacaagacctgggcgtaccacgggtcctacgaggtgaagcccagcggcagcgcctccagcatggtcaacggggtggtgaagctcctgacgaagccgtgggacgtcatccccatggtgacccagatcgccatgaccgacaccacgcccttcggccagcagcgcgtgttcaaggagaaggtcgacacccggacccccaaggccaagcgcgggaccgcccagatcatggaggtgacggcgaagtggctgtggggcttcctctcccggaacaagaagccgcgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagcccgagcacgcgctcctggccaagtccatcttcaagctgacgtaccagaacaaggtcgtgcgggtgcagcgcccggccaagaacgggaccgtcatggacgtgatcagccgccgggaccagcgcggctccggccaggtgggcacctacggcctcaacaccttcacgaacatggaggcccagctgatccggcagatggagagcgaggggatcttctcccccagcgagctggagacccccaacctcgccggccgcgtcctggactggctggagaagcacggggtggagcggctcaagcgcatggcgatctccggcgacgactgcgtggtcaagcccatcgacgaccggttcgccaccgccctgaccgccctgaacgacatggggaaggtgcgcaaggacatcccgcagtgggagcccagcaagggctggaacgactggcagcaggtccccttctgcagccaccacttccaccagctcatcatgaaggacggccgggagatcgtcgtgccctgccgcaaccaggacgagctggtggggcgggcccgcgtctcccagggcgcggggtggagcctgcgggagacggcctgcctcggcaagtcctacgcccagatgtggcagctgatgtacttccaccgccgggacctgcgcctcgccgcgaacgccatctgcagcgccgtgccggtggactgggtccccacctcccggaccacctggagcatccacgcccaccaccagtggatgacgaccgaggacatgctgtccgtgtggaaccgcgtgtggatcgaggagaacccctggatggaggacaagacccacatcagctcctggggcgacgtcccctacctgggcaagcgggaggaccagtggtgcggcagcctcatcgggctgaccgcccgcgcgacgtgggccaccaacatccaggtggccatcaaccaggtgcgccggctgctcggcaacgagaactacctggactacatgacctccatgaagcgcttcaagaacgagagcgacccggagggggccctgtggtga

SEQ ID NO: 8609 - RNA, 9879 nt, synthetic construct
  misc_feature 1..9879: note = derived and/or modified CDS sequence (opt1) from DENV-1__GU131685__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggagaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctgatccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgggatgaagttcacggtcgtggtgggcgacgtcgccgggatcctcgcgcagggcaagaagatgatccggccccagcccatggagtacaagtacagctggaagtcctggggcaaggccaagatcatcggggccgacgtgcagaacaccaccttcatcatcgacggccccaacaccccggagtgccccgacgaccagcgcgcctggaacatctgggaggtggaggactacgggttcggcatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtggtcgacgagcactgcgggaaccggggcccgtccctgcgcaccaccacggtgaccgggaagatcatccacgagtggtgctgccggagctgcaccctgccgcccctccgcttccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggacgctggccgtgttcttcctgctcatcatgggccagctgacctggaacgacctgatccgcctctgcatcatggtgggggccaacgcgagcgaccgcatgggcatgggcaccacctacctggccctgatggccacgttcaagatgcggccgatgttcgccgtcgggctcctgttccgccggctgacctcccgcgaggtgctcctgctgaccatcgggctcagcctggtggcctccgtcgagctgcccaacagcctcgaggagctgggggacggcctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctggggagcctcggctgcaagccgctgaccatgttcctgatcgcggagaacaagatctgggggcggcgctcctggcccctcaacgagggcatcatggccgtggggatcgtcagcatcctgctgagctccctcctgaagaacgacgtgcccctggccggccccctcatcgccggcgggatgctgatcgcctgctacgtgatcagcggctccagcgcggacctgtccctcgagaaggccgccgaggtcagctgggaggaggaggccgagcactccggggccagccacaacatcctggtggaggtgcaggacgacggcaccatgaagatcaaggacgaggagcgggacgacaccctgaccatcctcctgaaggcgacgctgctcgccgtctccggggtgtacccgctgagcatccccgccaccctgttcgtgtggtacttctggcagaagaagaagcagcgctccggcgtcctctgggacacccccagcccgcccgaggtggagcgggccgtgctggacgacggcatctaccgcatcatgcagcgggggctgctgggccgctcccaggtcggggtgggcgtgttccaggagaacgtcttccacaccatgtggcacgtgacgcgcggggccgtgctcatgtaccagggcaagcgcctggagcccagctgggcgtccgtcaagaaggacctgatcagctacggcgggggctggcggctccaggggtcctggaacaccggcgaggaggtccaggtgatcgccgtcgagcccgggaagaaccccaagaacgtgcagaccgcccccggcaccttcaagacgcccgagggcgaggtgggggccatcgccctggacttcaagcccggcaccagcgggtcccccatcgtcaaccgcgagggcaagatcgtgggcctgtacgggaacggcgtggtcaccaccagcgggacgtacgtgagcgcgatcgcccaggccaaggcctcccaggagggcccgctccccgagatcgaggacgaggtgttccggaagcgcaacctgaccatcatggacctgcaccccgggagcggcaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtgcgcgtcccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtggaggcgttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctctcccggaagacgttcgacaccgagtaccagaagaccaagaacaacgactgggactacgtggtgaccacggacatcagcgagatgggggccaacttccgcgcggaccgggtcatcgacccgcgccggtgcctgaagcccgtgatcctgaaggacggccccgagcgcgtgatcctcgccgggcccatgccggtcaccgtggcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtcgagctcatgcgccggggcgacctgcccgtgtggctgtcctacaaggtggccagcgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtgtccggcgacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccgggggcgtgaccctcttcttcctgtccgggcggggcctgggcaagaccagcatcgggctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcggcctcctgttcatgatcctgaccgtcgccgccaacgagatggggctcctggagaccaccaagaaggacctgggcatcgggcacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtgcccctcctggccctgggctgctacagccaggtcaaccccctcacgctgaccgccgcggtgctgatgctcgtggcccactacgccatcatcgggccgggcctgcaggccaaggccacccgcgaggcgcagaagcggaccgccgccgggatcatgaagaaccccacggtcgacggcatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtggaccgcagcgaggccaaggaggggctgaagcggggcgagaccaccaagcacgcggtctcccgcgggaccgccaagctccggtggttcgtggagcgcaacctggtgaagcccgagggcaaggtcatcgacctgggctgcgggcggggcgggtggagctactactgcgccggcctgaagaaggtgacggaggtgaaggggtacaccaagggcggccccgggcacgaggagcccatcccgatggccacctacggctggaacctcgtcaagctgcactccgggaaggacgtgttcttcatcccgcccgagaagtgcgacaccctgctctgcgacatcggcgagagctcccccaacccgacgatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccggaacagcacccacgagatgtactgggtgtcctgcggcaccgggaacatcgtgagcgccgtcaacatgacgtcccgcatgctgctcaaccgcttcaccatggcgcaccggaagcccacctacgagcgcgacgtggacctgggcgccggcacccggcacgtggccgtcgagcccgaggtggccaacctggacatcatcgggcagcgcatcgagaacatcaagcacgagcacaagagcacgtggcactacgacgaggacaacccctacaagacctgggcctaccacggctcctacgaggtgaagccgagcgggtccgcgagcagcatggtcaacggcgtggtcaagctcctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgccaagtggctgtggggcttcctctcccgcaacaagaagccccggatctgcacccgcgaggagttcacgcggaaggtccgcagcaacgcggccatcggggccgtgttcgtggacgagaaccagtggaactccgccaaggaggcggtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatccccggcggcaacatgtacgccgacgacaccgccgggtgggacacccggatcacggaggacgacctgcagaacgaggcccgcatcaccgacatcatggagccggagcacgccctcctggcgcgctccatcttcaagctgacctaccagaacaaggtggtgcgggtccagcgccccgccaagaacggcaccgtgatggacgtgatcagccggcgcgaccagcgggggtccggccaggtcggcacgtacgggctcaacaccttcaccaacatggaggcccagctgatccgccagatggagagcgagggcatcttctcccccagcgagctggagacccccaacctcgccgagcgggtgctggactggctggagaagtacggggtggagcgcctcaagcggatggccatctccggcgacgactgcgtcgtgaagccgatcgacgaccgcttcgcgacggccctgaccgccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcgtgcctcggcaagtcctacgcccagatgtggcagctgatgtacttccaccggcgcgacctgcggctcgccgccaacgcgatctgcagcgccgtgcccgtcgactggatccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctgggcaagcgggaggaccagtggtgcggcagcctcatcgggctgaccgcccgcgccacctgggcgaccaacatccaggtggccatcaaccaggtgcggcgcctgatcggcaacgagaactacctcgactacatgacctccatgaagcggttcaagaacgagagcgaccccgagggggccctgtggtga

SEQ ID NO: 8610 - RNA, 9879 nt, synthetic construct
  misc_feature 1..9879: note = derived and/or modified CDS sequence (opt1) from DENV-1__GQ868614__SS-prME
  source 1..9879: mol_type = other RNA
agcgtgaccatgctgctcatgctgatgcccaccgccctggccttccacctcaccacccggggcggggagccgcacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggcccttcaagctcgagaaggaggtcgcggagacgcagcacggcaccgtgctggtgcagatcaagtacgagggcaccgacgccccctgcaagatcccgttctccacccaggacgagaagggggtcatccagaacggccggctgatcacggccaaccccatcgtgaccgacaaggagaagcccgtgaacatcgaggccgagcccccgttcggggagagctacatcgtcatcggcgtgggcgagaaggcgctgaagctctcctggttcaagaaggggagctccatcggcaagatgttcgaggccaccgcccgcggggcccggcgcatggccatcctgggcgacaccgcgtgggacttcgggagcatcggcggcgtgttcacgtccgtcgggaagctggtgcaccagatcttcggcgccgcctacggggtcctgttcagcggcgtctcctggaccatgaagatcgggatcggcgtgctgctgacctggctcggcctgaacagccgctccaccagcctgtccatgacgtgcatcgccgtggggctcgtcaccctgtacctgggcgtgatggtgcaggccgacagcgggtgcgtcatcaactggaagggccgggagctcaagtgcgggtccggcatcttcgtgaccaacgaggtgcacacctggacggagcagtacaagttccaggcggacagccccaagcgcctgagcgccgccatcggcaaggcctgggaggagggggtctgcggcatccggtccgtgacccgcctggagaacatcatgtggaagcagatcagcaacgagctcaaccacatcctgctggagaacgacatgaagttcaccgtggtcgtgggggacgtggtcggcatcctcgcccaggggaagaagatgatccggccccagcccatggagcacaagtactcctggaagtcctggggcaaggcgaagatcatcggcgccgacgtgcagaacaccaccttcatcatcgacgggccgaacacgcccgagtgccccgacgaccagcgcgcctggaacatctgggaggtggaggactacggcttcgggatcttcaccaccaacatctggctgaagctgcgggactcctacacccaggcctgcgaccaccgcctcatgagcgcggccatcaaggactccaaggccgtccacgccgacatgggctactggatcgagagcgagaagaacgagacgtggaagctggcccgggcgtccttcatcgaggtgaagacctgcatctggcccaagagccacaccctgtggtccaacggcgtgctcgagagcgagatggtcatcccgaagatctacgggggccccatctcccagcacaactaccgccccgggtacttcacccagacggccggcccgtggcacctggggaagctggagctcgacttcgacctgtgcgagggcaccaccgtggtggtcgacgagcactgcggcaaccgggggcccagcctgcgcaccacgaccgtgaccggcaagatcatccacgagtggtgctgccggtcctgcaccctgccgcccctccgcttcaagggggaggacggctgctggtacgggatggagatccggccggtgaaggagaaggaggagaacctggtcaagagcatggtgtccgccggcagcggcgaggtggacagcttctccctcgggctgctgtgcatcagcatcatgatcgaggaggtcatgcgctcccggtggagccgcaagatgctcatgacgggcaccctggccgtgttcctgctcctgatcatggggcagctgacctggaacgacctcatccggctgtgcatcatggtgggcgccaacgcgtccgaccgcatggggatgggcaccacgtacctggccctcatggccaccttcaagatgcgccccatgttcgccgtcgggctgctgttccggcgcctcaccagccgggaggtgctgctgctcaccatcgggctgtccctggtcgccagcgtggagctccccaactccctggaggagctgggcgacgggctcgcgatgggcatcatgatcctgaagctgctcacggacttccagagccaccagctgtgggccaccctgctctccctgaccttcatcaagaccacgctgagcctccactacgcctggaagaccatggccatggtgctgtccatcgtcagcctgttccccctctgcctgtccaccaccagccagaagacgacctggctgccggtgctcctgggctccctggggtgcaagcccctcaccatgttcctgatcgcggagaacaagatctggggccgcaagagctggcccctgaacgaggggatcatggccgtgggcgtcgtgtccatcctcctgagcagcctgctcaagaacgacgtgcccctggccgggccgctgatcgccggcggcatgctcatcgcctgctacgtcatctccgggagctccgcggacctgagcctggagaaggccgccgaggtgtcctgggaggaggaggccgagcacagcggcgcctcccacaacatcctcgtggaggtccaggacgacgggaccatgaagatcaaggacgaggagcgggacgacacgctgaccatcctgctcaaggcgaccctgctggccgtgagcggcgtgtaccccctctccatccccgccaccctgttcgtctggtacttctggcagaagaagaagcagcgcagcggggtgctgtgggacaccccctccccgcccgaggtggagcgggccgtcctggacgacggcatctaccgcatcatgcagcggggcctcctggggcgcagccaggtgggcgtgggggtcttccaggagaacgtgttccacacgatgtggcacgtgacccggggcgccgtcctgatgtaccaggggaagcgcctcgagccctcctgggcgagcgtgaagaaggacctgatctcctacggcggcgggtggcggctgcagggcagctggaacaccggggaggaggtgcaggtcatcgccgtggagcccggcaagaacccgaagaacgtgcagaccgcccccgggacgttcaagacccccgagggcgaggtcggcgccatcgccctcgacttcaagcccgggacctccggcagcccgatcgtgaaccgcgaggggaagatcgtgggcctgtacggcaacggggtcgtgaccacgtccggcacctacgtgagcgcgatcgcccaggccaaggccagccaggaggggcccctgcccgagatcgaggacgaggtcttccggaagcgcaacctcaccatcatggacctgcacccgggctccgggaagacccggcgctacctgcccgcgatcgtgcgggaggccatcaagcgcaagctccggacgctgatcctggcccccacccgcgtggtcgccagcgagatggccgaggcgctcaagggcatgcccatccgctaccagaccaccgccgtgaagtccgagcacacgggcaaggagatcgtggacctgatgtgccacgccaccttcaccatgcggctgctcagcccggtccgcgtgcccaactacaacatgatcatcatggacgaggcccacttcaccgacccctccagcatcgccgcgcgggggtacatctccacgcgcgtgggcatgggggaggccgccgccatcttcatgaccgccacgccgcccggcagcgtcgaggcgttcccccagtccaacgccgtgatccaggacgaggagcgggacatccccgagcgcagctggaactccgggtacgagtggatcaccgacttccccggcaagacggtgtggttcgtccccagcatcaagtccggcaacgacatcgccaactgcctgcggaagaacgggaagcgcgtgatccagctgagccggaagaccttcgacaccgagtaccagaagaccaagaacaacgactgggactacgtggtcacgaccgacatctccgagatgggcgccaacttccgcgcggaccgggtgatcgacccccgccggtgcctcaagcccgtcatcctgaaggacgggcccgagcgcgtgatcctggccggcccgatgcccgtgaccgtcgccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacgcccgagggcatcatcccggccctcttcgagcccgagcgggagaagtccgccgccatcgacggggagtaccgcctgcgcggcgaggcgcggaagaccttcgtggagctgatgcgccgcggggacctccccgtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctacagcgacccgctggccctccgggagttcaaggagttcgccgcgggccgccggtccgtcagcggggacctgatcctggagatcggcaagctcccccagcacctgacgcagcgcgcccagaacgccctggacaacctcgtgatgctgcacaactccgagcagggcgggcgggcctaccgccacgcgatggaggagctgcccgacaccatcgagaccctcatgctgctggccctcatcgccgtgctgaccggcggggtcacgctgttcttcctcagcggccgggggctgggcaagacctccatcggcctgctctgcgtgatggccagctccgtgctgctgtggatggccagcgtcgagccccactggatcgcggcctccatcatcctcgagttcttcctgatggtgctgctcatcccggagcccgaccgccagcggacgccccaggacaaccagctggcctacgtggtcatcgggctcctcttcatgatcctgaccgtggccgccaacgagatgggcctgctcgagaccacgaagaaggacctggggatcggccacgtggcggtcgagaaccaccaccacgccaccatgctggacgtggacctccacccggccagcgcctggaccctgtacgccgtggcgaccacgatcatcacccccatgatgcgccacaccatcgagaacaccacggccaacatctccctgaccgccatcgccaaccaggccgcgatcctcatggggctggacaagggctggcccatcagcaagatggacatcggcgtccccctgctcgccctggggtgctactcccaggtgaacccgctgaccctcaccgccgccgtgctgatgctggtcgcgcactacgccatcatcggccccgggctccaggccaaggccacgcgggaggcccagaagcgcaccgcggccggcatcatgaagaaccccaccgtggacgggatcgtggccatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgcgaccggcccgctgacgaccctgtgggaggggagccccggcaagttctggaacaccaccatcgccgtgtccatggccaacatcttccgggggagctacctcgccggcgccggcctggcgttctccctgatgaagtccctcgggggcgggcgccggggcacgggggcccagggcgagaccctgggcgagaagtggaagcgccagctgaaccagctcagcaagtccgagttcaacatctacaagcggagcgggatcatggaggtcgaccgctccgaggccaaggagggcctgaagcgcggggagaccacccgccacgccgtgagccggggcacggcgaagctgcgctggttcgtggagcggaacctggtcaagcccgaggggaaggtgatcgacctcggctgcggccgcgggggctggtcctactactgcgccgggctgaagaaggtgaccgaggtcaagggctacaccaagggcgggcccggccacgaggagccgatccccatggccacctacgggtggaacctggtgaagctccacagcggcaaggacgtgttcttcacgccgcccgagaagtgcgacaccctgctgtgcgacatcggggagtccagcccgaaccccaccatcgaggagggccggaccctccgcgtcctgaagatggtggagccctggctgcgggggaaccagttctgcatcaagatcctcaacccctacatgccgtccgtggtcgagacgctggagcagatgcagcgcaagcacggcggcatgctggtgcggaaccccctcagccgcaactccacccacgagatgtactgggtgagctgcgggaccggcaacatcgtctccgccgtgaacatgaccagccggatgctgctgaaccgcttcaccatggcccaccgcaagcccacgtacgagcgggacgtggacctcggggcgggcacccgccacgtcgccgtggagcccgaggtcgccaacctggacatcatcggccagcggatcgagaacatcaagcacgagcacaagtccacctggcactacgacgaggacaacccgtacaagacctgggcctaccacgggagctacgaggtgaagccctccggcagcgcctccagcatggtgaacggggtcgtgaagctgctcacgaagccctgggacgtgatccccatggtcacccagatcgcgatgaccgacaccacgccgttcggccagcagcgcgtgttcaaggagaaggtggacacccggacccccaaggccaagcgcgggaccgcccagatcatggaggtcacggcccggtggctgtggggcttcctgagccgcaacaagaagccccggatctgcacccgcgaggagttcacccggaaggtgcgctccaacgccgcgatcggcgccgtgttcgtcgacgagaaccagtggaacagcgccaaggaggccgtggaggacgagcggttctgggacctcgtgcagaaggagcgcgagctgcacaagcaggggaagtgcgcgacctgcgtctacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccggcgggaacatgtacgcggacgacacggccgggtgggacacccgcatcaccgaggacgacctgcagaacgaggccaagatcaccgacatcatggagcccgagcacgccctgctcgccacgagcatcttcaagctgacctaccagaacaaggtggtccgggtgcagcgccccgcgaagaacgggaccgtgatggacgtcatctcccgccgggaccagcgcggcagcggccaggtgggcacctacggcctgaacacgttcaccaacatggaggcccagctcatccggcagatggagtccgaggggatcttcctgcccagcgagctggagaccccgaacctcgccgagcgcgtgctggactggctggagaagcacggcgtcgagcggctcaagcgcatggccatctccggggacgactgcgtggtgaagcccatcgacgaccggttcgccaccgcgctgacggccctgaacgacatgggcaaggtccgcaaggacatcccccagtgggagcccagcaaggggtggaacgactggcagcaggtcccgttctgctcccaccacttccaccagctcatcatgaaggacggccgggagatcgtggtcccctgccgcaaccaggacgagctggtgggccgggcccgcgtgagccagggggccggctggtccctgcgggagaccgcctgcctcggcaagagctacgcgcagatgtggcagctgatgtacttccaccgccgggacctgcgcctcgccgccaacgccatctgcagcgcggtccccgtggactgggtgcccacctcccggaccacgtggagcatccacgcccaccaccagtggatgaccaccgaggacatgctgtccgtctggaaccgcgtgtggatcgaggagaacccgtggatggaggacaagacccacgtgagctcctggggcgacgtcccctacctggggaagcgggaggaccagtggtgcggcagcctcatcggcctgacggcccgcgccacctgggcctccaacatccaggtggcgatcaaccaggtgcgccggctgatcgggaacgagaactacctcgactacatgaccagcatgaagcgcttcaagaacgagggcgaccccgagggggccctgtggtga

SEQ ID NO: 8611 - RNA, 9879 nt, synthetic construct
  misc_feature 1..9879: note = derived and/or modified CDS sequence (opt1) from DENV-1__GU131688__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatgacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtcgtggacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtggggctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtcctgtccatcgtgagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccgccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgccaccctgttcgtctggtacttctggcagaagaagaagcagcgctccggggtgctgtgggacacgcccagcccgcccgaggtggagcgggcggtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcccccgggaccttcaagaccagcgagggcgaggtcggcgcgatcgccctcgacttcaagcccgggacctccggcagccccatcgtgaaccgcgaggggaagatcgtgggcctgtacggcaacggggtcgtgacgaccagcggcacctacgtgtccgccatcgcccaggcgaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggccccgacccgcgtggtcgcgagcgagatggccgaggccctcaagggcatgcccatccgctaccagaccacggccgtgaagtccgagcacaccggcaaggagatcgtggacctgatgtgccacgccaccttcaccatgcggctgctcagccccgtccgcgtgcccaactacaacatgatcatcatggacgaggcgcacttcacggacccgtccagcatcgccgcccgggggtacatctccacccgcgtgggcatgggggaggccgccgcgatcttcatgaccgccacgccgcccggcagcgtcgaggccttcccccagtccaacgccgtgatccaggacgaggagcgggacatcccggagcgcagctggaactccgggtacgagtggatcacggacttccccggcaagaccgtgtggttcgtccccagcatcaagtccggcaacgacatcgcgaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgccagcgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccccagcacctgacccagcgcgcccagaacgcgctggacaacctcgtgatgctgcacaactccgagcagggcgggcgggcctaccgccacgccatggaggagctgccggacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcacccccatgatgcgccacaccatcgagaacaccacggccaacatctccctgaccgcgatcgccaaccaggccgccatcctcatggggctggacaagggctggccgatcagcaagatggacatcggcgtccccctgctcgcgctggggtgctactcccaggtgaaccccctgaccctcaccgccgccgtgctgatgctggtcgcccactacgccatcatcggccccgggctccaggcgaaggccacgcgggaggcccagaagcgcaccgccgccggcatcatgaagaacccgaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagccccggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcatcccgcccgagaagtgcgacaccctgctgtgcgacatcggggagtccagccccaaccccaccatcgaggagggccgcaccctccgggtcctgaagatggtggagccgtggctgcgcgggaaccagttctgcatcaagatcctcaacccctacatgccctccgtggtcgagacgctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcaccatggcccaccgcaagccgacgtacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacctgggcctaccacgggagctacgaggtcaagccctccggcagcgccagctccatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcgcagatcatggaggtcacggccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgaagatcaccgacatcatggagcccgagcacgccctgctcgccaagagcatcttcaagctgacgtaccagaacaaggtggtccgcgtgcagcggccggccaagaacgggaccgtgatggacgtcatctcccgccgcgaccagcggggcagcggccaggtgggcacctacggcctgaacaccttcacgaacatggaggcccagctcatccgccagatggagtccgaggggatcttcagcccctccgagctggagacccccaacctggcgggccgggtgctcgactggctggagaagcacggggtcgagcgcctgaagcggatggccatcagcggcgacgactgcgtggtgaagcccatcgacgaccgcttcgccgccgccctcaccgcgctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcccgggtgagccagggcgccgggtggtccctgcgcgagaccgcctgcctgggcaagagctacgcgcagatgtggcagctcatgtacttccaccggcgcgacctgcggctggccgccaacgccatctgctccgccgtcccggtggactgggtgcccacgagccgcaccacctggtccatccacgcgcaccaccagtggatgaccacggaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcccgggccacctgggccacgaacatccaggtcgccatcaaccaggtgcgccgcctgatcggcaacgagaactacctggactacatgaccagcatgaagcggttcaagaacgagtccgacccggagggggcgctctggtga

SEQ ID NO: 8612 - RNA, 9879 nt, synthetic construct
  misc_feature 1..9879: note = derived and/or modified CDS sequence (opt1) from DENV-1__GU131689__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggggagttctgcgaggacacgatgacctacaagtgcccccggatcaccgaggccgagcccgacgacgtggactgctggtgcaacgccaccgacacctgggtgacctacgggacctgcagccagaccggggagcaccggcgggacaagcggtccgtggccctggcgccccacgtgggcctggggctcgagacgcgcaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccagcacggagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggaccagcggggcctccaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccagatcaagtacgagggcaccgacgccccctgcaagatccccttctccacccaggacgagaagggggtgacccagaacggccggctcatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctcgtgcaccagatcttcggcaccgcctacggggtgctgttcagcggcgtctcctggaccatgaagatcgggatcggcgtgctgctcacctggctgggcctgaacagccgctccacgagcctctccatgacctgcatcgccgtggggctggtcaccctgtacctcggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagctgaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcgtgtggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctcttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatccgcacgaccttcagcctccactacgcctggaagaccatggcgatggtgctgtccatcgtgagcctgttccccctctgcctgtccaccacgagccagaagaccacctggctgcccgtcctcctgggctccctggggtgcaagccgctcaccatgttcctgatcgccgagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggacgatgaagatcaaggacgaggagcgcgacgacaccctgaccatcctgctcaaggccaccctgctggccgtgagcggcgtctacccgctctccatccccgccaccctgttcgtgtggtacttctggcagaagaagaagcagcggagcggggtgctgtgggacacgcccagcccgcccgaggtcgagcgcgccgtgctcgacgacggcatctaccggatcatgcagcgcggcctgctggggcggagccaggtgggcgtcggggtgttccaggagaacgtgttccacaccatgtggcacgtcacccgcggcgcggtgctgatgtaccaggggaagcggctcgagccctcctgggccagcgtgaagaaggacctgatctcctacggcggcgggtggcgcctgcagggcagctggaacaccggggaggaggtccaggtgatcgccgtggagcccggcaagaaccccaagaacgtccagacggcccccgggaccttcaagacctccgagggcgaggtgggcgccatcgcgctcgacttcaagcccgggaccagcggcagccccatcgtgaaccgggaggggaagatcgtcggcctgtacggcaacggggtggtgacgacctccggcacctacgtcagcgccatcgcccaggccaaggcgtcccaggaggggcccctgccggagatcgaggacgaggtgttccgcaagcggaacctcaccatcatggacctgcaccccggcagcgggaagacgcgccggtacctgcccgccatcgtgcgcgaggccatgaagcggcgcctccgcaccctgatcctggccccgacccgggtcgtggcctccgagatggcggaggccctcaagggcatgcccatccgctaccagaccacggccgtcaagagcgagcacaccggcaaggagatcgtcgacctgatgtgccacgccaccttcaccatgcggctgctctcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctgcggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctcaagccggtcatcctgaaggacgggcccgagcgcgtgatcctggccggccccatgcccgtcaccgtggcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccggctgcgcggcgaggcccggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgcggccggccgccggagcgtgtccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtcctgacgggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcgggctcctcttcatgatcctgaccgtggccgcgaacgagatgggcctgctcgagacgaccaagaaggacctggggatcggccacgtcgccgtggagaaccaccaccacgccgccatgctggacgtggacctccaccccgcctccgcgtggaccctgtacgccgtcgccaccacgatcatcacccccatgatgcgccacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtgaaccccctgaccctcaccgcggccgtcctgatgctggtggcccactacgccatcatcggccccgggctccaggccaaggcgacgcgcgaggcccagaagcggaccgccgccggcatcatgaagaacccgaccgtggacgggatcgtcgccatcgacctggaccccgtggtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtcagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccgcttcaccatggcccaccggaagccgacgtacgagcgcgacgtcgacctcggggccggcacccggcacgtggccgtggagcccgaggaggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcgcccggccaagaacgggaccgtgatggacgtcatcagccggcgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacgtgagctcctggggcgacgtcccctacctgggcaagcgcgaggaccagtggtgcggcagcctgatcgggctcaccgcccgcgcgacgtgggccaccaacatccaggtggccatcaaccaggtgcggcgcctgctgggcaacgagaactacctcgactacatgacctccatgaagcggttcaagaacgagagcgacccggagggggccctgtggtga

SEQ ID NO: 8613 - RNA, 9879 nt, synthetic construct
  misc_feature 1..9879: note = derived and/or modified CDS sequence (opt1) from DENV-1__GU131690__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgtcacccgcctcgagaacatcatgtggaagcagatctccaacgagctgaaccacatcctgctcgagaacgacatgaagttcacggtggtggtcggggacgtggccggcatcctggcccaggggaagaagatgatccggccccagcccatggagcacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcgtcgggcagctgacctggaacgacctcatccgcctgtgcatcatggtgggcgccaacgccagcgaccgcatggggatgggcaccacctacctggcgctcatggccacgttcaagatgcggccgatgttcgccgtgggcctgctgttccgccggctcacctcccgcgaggtcctgctgctcaccatcgggctgagcctggtggcctccgtcgagctccccaacagcctggaggagctgggcgacgggctcgccatgggcatcatgatcctgaagctgctcaccgacttccagtcccaccagctgtgggcgacgctgctcagcctgaccttcatcaagaccaccttctccctgcactacgcctggaagacgatggccatggtgctcagcgtggtctccctgttccccctgtgcctcagcaccacctcccagaagaccacgtggctgcccgtgctgctcggcagcctggggtgcaagccgctgaccatgttcctcatcgccgagaacaagatctggggccggcgctcctggcccctgaacgaggggatcatggcggtgggcatcgtcagcatcctgctcagctccctgctgaagaacgacgtgcccctcgccgggcccctgatcgccggcggcatgctgatcgcctgctacgtgatcagcgggtccagcgccgacctctccctggagaaggcggccgaggtcagctgggaggaggaggccgagcactccggcgccagccacaacatcctggtggaggtgcaggacgacgggaccatgaagatcaaggacgaggagcgggacgacaccctcaccatcctgctgaaggccacgctcctggcggtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcctccgtcaagaaggacctcatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcaccctcatcctggcccccacgcgggtggtggcctccgagatggccgaggccctgaagggcatgcccatccgctaccagaccaccgcggtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctgaagcccgtgatcctcaaggacgggcccgagcgcgtcatcctggcgggccccatgccggtgaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgcgagaagtccgccgccatcgacggggagtaccggctccgcggcgaggcccggaagacgttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacccagcgcgcgcagaacgccctggacaacctggtcatgctccacaacagcgagcagggcgggcgggcctaccgccacgccatggaggagctgcccgacacgatcgagaccctgatgctcctggcgctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggccgtggagaaccaccaccacgcggccatgctggacgtcgacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtcaaccccctgacgctgaccgccgccgtgctcatgctggtggcgcactacgccatcatcggcccggggctgcaggccaaggccacccgcgaggcccagaagcggaccgcggccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgccgtctcccgcggcaccgcgaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcccaccggaagcccacctacgagcgcgacgtggacctgggggcgggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctgaccaagccctgggacgtgatccccatggtgacccagatcgcgatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgccgcgatcggcgccgtgttcgtggacgagaaccagtggaactccgccaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgcggacgacaccgccggctgggacacccggatcacggaggacgacctccagaacgaggcccgcatcaccgacatcatggagccggagcacgccctgctggccaagtccatcttcaagctcacctaccagaacaaggtggtgcgcgtccagcggcccgcgaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtggagcggctgaagcgcatggccatctccggggacgactgcgtcgtgaagccgatcgacgaccggttcgccacggcgctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcctgcctggggaagtcctacgcgcagatgtggcagctgatgtacttccaccgccgggacctccgcctggccgccaacgccatctgcagcgcggtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggccaccaacatccaggtggcgatcaaccaggtgcgccggctcatcgggaacgagaactacctggactacatgacctccatgaagcgcttcaagaacgagagcgaccccgagggcgccctgtggtga

SEQ ID NO: 8614 - RNA, 9879 nt, synthetic construct
  misc_feature 1..9879: note = derived and/or modified CDS sequence (opt1) from DENV-1__GU131695__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgggatgaagttcacggtggtggtcggcgacgtggccgggatcctcgcgcagggcaagaagatgatccggccccagcccatggagtacaagtacagctggaagtcctggggcaaggccaagatcatcggggccgacgtgcagaacaccaccttcatcatcgacggccccaacaccccggagtgccccgacgaccagcgcgcctggaacatctgggaggtcgaggactacgggttcggcatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtcgtggacgagcactgcgggaaccggggcccgtccctgcgcaccaccacggtgaccgggaagatcatccacgagtggtgctgccggacctgcaccctgccgcccctccgcttccggggcgaggacgggtgctggtacggcatggagatccgccccgtcaaggagaaggaggagaacctggtgaagtccatggtgtccgccggcagcggggaggtcgacagcttctccctcggcctgctgtgcatcagcatcatgatcgaggaggtgatgcggtcccgctggagccggaagatgctcatgacggggaccctggccgtgttcttcctgctcatcatgggccagctgacctggaacgacctgatccgcctctgcatcatggtcggggccaacgcgtccgaccgcatgggcatgggcaccacgtacctggccctgatggccaccttcaagatgcggccgatgttcgccgtggggctcctgttccgccggctgaccagccgcgaggtgctcctgctgaccatcgggctctccctggtcgccagcgtggagctgcccaactccctcgaggagctgggggacggcctggcgatgggcatcatgatcctcaagctgctgacggacttccagagccaccagctctgggccaccctgctgtccctcaccttcatcaagaccacgttcagcctgcactacgcctggaagaccatggccatggtcctgtccatcgtgagcctcttccccctgtgcctgtccaccaccagccagaagacgacctggctccccgtgctgctggggtccctcggctgcaagccgctgaccatgttcctgatcgcggagaacaagatctgggggcggcgcagctggcccctcaacgagggcatcatggccgtcgggatcgtgtccatcctgctgagcagcctcctgaagaacgacgtgcccctggccggccccctcatcgccggcgggatgctgatcgcctgctacgtcatctccggcagctccgcggacctgagcctcgagaaggccgccgaggtgtcctgggaggaggaggccgagcacagcggggcctcccacaacatcctggtggaggtccaggacgacggcaccatgaagatcaaggacgaggagcgggacgacaccctgacgatcctcctgaaggcgaccctgctcgccgtgagcggggtgtacccgctgtccatccccgccaccctgttcgtctggtacttctggcagaagaagaagcagcgcagcggcgtgctctgggacacccccagcccgcccgaggtggagcgggccgtcctggacgacggcatctaccgcatcatgcagcgggggctgctgggccgcagccaggtgggggtgggcgtcttccaggagaacgtgttccacacgatgtggcacgtgacccgcggggccgtcctcatgtaccagggcaagcgcctggagccctcctgggcgagcgtgaagaaggacctgatctcctacggcgggggctggcggctccaggggagctggaacaccggcgaggaggtgcaggtcatcgccgtggagcccgggaagaaccccaagaacgtgcagaccgcccccggcacgttcaagacccccgagggcgaggtcggggccatcgccctggacttcaagcccggcacctccgggagccccatcgtgaaccgcgagggcaagatcgtgggcctgtacgggaacggcgtcgtgaccacgtccgggacctacgtgagcgcgatcgcccaggccaaggccagccaggagggcccgctccccgagatcgaggacgaggtcttccggaagcgcaacctgaccatcatggacctgcaccccgggtccggcaagacccggcgctacctcccggcgatcgtgcgggaggccatcaagcgcaagctgcgcacgctgatcctcgcccccacccgggtggtcgccagcgagatggccgaggcgctgaagggcatgcccatccgctaccagaccaccgccgtgaagtccgagcacacggggaaggagatcgtggacctgatgtgccacgccaccttcaccatgcggctcctgagccccgtccgcgtgccgaactacaacatgatcatcatggacgaggcccacttcaccgacccctccagcatcgccgcgcggggctacatctccacgcgcgtggggatgggcgaggccgccgccatcttcatgaccgccacgccgcccgggagcgtcgaggcgttcccgcagtccaacgccgtgatccaggacgaggagcgggacatccccgagcgcagctggaactccggctacgagtggatcaccgacttccccggcaagacggtgtggttcgtccccagcatcaagtccgggaacgacatcgccaactgcctgcggaagaacggcaagcgcgtgatccagctcagccggaagaccttcgacaccgagtaccagaagaccaagaacaacgactgggactacgtggtcacgaccgacatctccgagatgggggccaacttccgcgcggaccgggtgatcgacccgcgccggtgcctgaagcccgtgatcctgaaggacggccccgagcgcgtcatcctcgccgggcccatgccggtgaccgtcgccagcgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacgcccgaggggatcatccccgccctgttcgagccggagcgcgagaagtccgccgccatcgacggcgagtaccggctgcgcggggaggcgcggaagaccttcgtggagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctacagcgaccccctcgccctgcgggagttcaaggagttcgccgcggggcgccggtccgtcagcggcgacctgatcctcgagatcggcaagctgccgcagcacctgacgcagcgcgcccagaacgccctcgacaacctggtgatgctgcacaactccgagcagggcgggcgggcctaccgccacgcgatggaggagctccccgacaccatcgagaccctgatgctgctcgccctgatcgccgtgctgaccgggggcgtcaccctcttcttcctgagcgggcggggcctgggcaagacgtccatcgggctcctgtgcgtgatggccagctccgtgctgctctggatggccagcgtcgagccccactggatcgcggcctccatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccacgaagaaggacctgggcatcgggcacgtggcggtcgagaaccaccaccacgccgccatgctcgacgtggacctgcaccccgccagcgcctggaccctgtacgcggtggccaccaccatcatcacgccgatgatgcgccacaccatcgagaacaccaccgccaacatctccctcacggccatcgccaaccaggcggccatcctgatgggcctggacaagggctggcccatcagcaagatggacatcggggtccccctcctggccctgggctgctactcccaggtgaaccccctcaccctgaccgccgcggtgctgatgctcgtcgcccactacgccatcatcgggccgggcctgcaggccaaggccacccgcgaggcgcagaagcggacggccgccgggatcatgaagaaccccaccgtggacggcatcgtggccatcgacctggaccccgtcgtgtacgacgccaagttcgagaagcagctcggccagatcatgctgctgatcctctgcaccagccagatcctgctgatgcgcaccacgtgggcgctctgcgagtccatcaccctggccaccgggcccctgaccacgctctgggagggcagcccggggaagttctggaacaccaccatcgccgtgtccatggccaacatcttccggggcagctacctggccggcgcggggctggccttctccctcatgaagtccctgggcgggggccgccgggggaccggcgcccagggcgagacgctgggggagaagtggaagcgccagctcaaccagctgagcaagtccgagttcaacacctacaagcggagcggcatcatggaggtcgaccgctccgaggccaaggaggggctgaagcggggcgagaccaccaagcacgcggtgagccgcgggacggccaagctccggtggttcgtggagcgcaacctggtcaagcccgagggcaaggtgatcgacctgggctgcgggcggggcgggtggtcctactactgcgccggcctgaagaaggtgaccgaggtcaaggggtacaccaagggcggccccgggcacgaggagcccatcccgatggccacctacggctggaacctcgtgaagctgcacagcgggaaggacgtgttcttcatcccgcccgagaagtgcgacacgctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacccacgagatgtactgggtgagctgcggcacggggaacatcgtctccgccgtgaacatgaccagccgcatgctgctcaaccgcttcaccatggcgcaccggaagcccacctacgagcgcgacgtggacctgggcgccggcacgcggcacgtcgccgtggagcccgaggtggccaacctggacatcatcgggcagcgcatcgagaacatcaagcacgagcacaagtccacctggcactacgacgaggacaacccctacaagacctgggcctaccacggcagctacgaggtcaagccgtccgggagcgcgtccagcatggtgaacggcgtcgtgaagctcctgaccaagccctgggacgtgatccccatggtcacgcagatcgccatgaccgacaccacccccttcgggcagcagcgggtgttcaaggagaaggtggacacgcgcaccccgaaggccaagcggggcaccgcccagatcatggaggtcaccgccaagtggctgtggggcttcctcagccgcaacaagaagccccggatctgcacgcgcgaggagttcacccggaaggtgcgctccaacgcggccatcggggccgtgttcgtcgacgagaaccagtggaacagcgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaagatccccggcggcaacatgtacgccgacgacaccgccgggtgggacacgcggatcaccgaggacgacctgcagaacgaggcccgcatcaccgacatcatggagccggagcacgccctcctggcgcgcagcatcttcaagctgacctaccagaacaaggtggtccgggtgcagcgccccgccaagaacggcacggtgatggacgtcatctcccggcgcgaccagcgggggagcggccaggtgggcacctacgggctcaacaccttcaccaacatggaggcccagctgatccgccagatggagtccgagggcatcttcagcccctccgagctggagacgcccaacctcgccgagcgggtgctggactggctggagaagtacggggtcgagcgcctcaagcggatggccatcagcggcgacgactgcgtggtgaagccgatcgacgaccgcttcgcgaccgccctgaccgccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgtcccagggcgccgggtggagcctgcgcgagaccgcgtgcctcggcaagagctacgcccagatgtggcagctgatgtacttccaccggcgcgacctgcggctcgccgccaacgcgatctgctccgccgtccccgtggactggatccccacgagccgcaccacctggtccatccacgcccaccaccagtggatgaccacggaggacatgctgagcgtgtggaaccgcgtctggatcgaggagaacccctggatggaggacaagacccacatctccagctggggcgacgtgccgtacctgggcaagcgggaggaccagtggtgcggctccctcatcgggctgaccgcccgcgccacctgggcgaccaacatccaggtggccatcaaccaggtccggcgcctgatcggcaacgagaactacctcgactacatgacgagcatgaagcggttcaagaacgagtccgaccccgagggggccctgtggtga

SEQ ID NO: 8615 - RNA, 9879 nt, synthetic construct
  misc_feature 1..9879: note = derived and/or modified CDS sequence (opt1) from DENV-1__GU131697__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagtaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaacaagcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccggctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccgccggatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagctcaccgtcgtggtgggggacgtcgcgggcatcctggggcagggcaagaagatgatccgcccccagcccatggagtacaagtacagctggaagtcctggggcaaggccaagatcatcggggccgacgcccagaacacgaccttcatcatcgacggccccaacaccccggagtgccccgacgaccagcgggcgtggaacatctgggaggtggaggactacgggttcggcatcttcaccacgaacatctggctgaagctccgcgacagctacacccaggtgtgcgaccaccggctgatgtccgccgccatcaaggacagcaaggccgtccacgccgacatgggctactggatcgagtccgagaagaacgagacctggaagctggcgcgcgccagcttcatcgaggtgaagacctgcatctggcccaagtcccacacgctctggagcaacggggtgctggagtccgagatgatcatccccaagatctacggcgggccgatcagccagcacaactaccggcccggctacttcacccagaccgccgggccctggcacctgggcaagctcgagctggacttcgacctgtgcgagggcaccacggtcgtggtggacgagcactgcgggaaccgcggcccgtccctccggaccaccaccgtcacggggaagatcatccacgagtggtgctgccgcagctgcaccctgccgcccctgcggttccgcggcgaggacgggtgctggtacggcatggagatccggcccgtgaaggagaaggaggagaacctcgtgaagtccatggtcagcgccggcagcggggaggtggactccttcagcctgggcctgctctgcatctccatcatgatcgaggaggtgatgcgcagccggtggtcccgcaagatgctgatgaccgggaccctggccgtcttcttcctcctgatcatgggccagctgacgtggaacgacctcatccggctgtgcatcatggtgggggcgaacgccttcgaccgcatgggcatgggcaccacctacctggccctcatggccaccttcaagatgcgcccgatgttcgccgtggggctgctgttccggcgcctcacgagccgggaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcgcaagagctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgggacgacaccctcaccatcctgctgaaggccaccctcctggccgtgagcggggtctacccgctgtccatccccgccaccctcttcgtgtggtacttctggcagaagaagaagcagcgcagcggcgtgctgtgggacacccccagcccgcccgaggtcgagcgggccgtgctggacgacggcatctaccgcatcatgcagcgggggctgctcggccgcagccaggtgggggtcggcgtgttccaggagaacgtgttccacaccatgtggcacgtcacccgcggggccgtgctgatgtaccagggcaagcgcctggagccctcctgggccagcgtgaagaaggacctcatctcctacggcgggggctggcggctgcgcgggagctggaacacgggcgaggaggtccaggtgatcgccgtggagcccgggaagaaccccaagaacgtccagaccgcccccggcaccttcaagacccccgagggcgaggtgggggccatcgcgctggacttcaagcccggcacgtccgggagccccatcgtgaaccgggagggcaagatcgtcggcctctacgggaacggcgtggtgaccacctccgggacctacgtcagcgccatcgcccaggccaaggcgagccaggagggcccgctgcccgagatcgaggacgaggtgttccgcaagcggaacctgacgatcatggacctccaccccgggtccggcaagacccgccggtacctgccggccatcgtgcgcgaggccatcaagcggaagctgcgcaccctcatcctggcccccacccgcgtcgtggccagcgagatggcggaggccctgaagggcatgcccatccggtaccagacgaccgccgtgaagtccgagcacaccgggaaggagatcgtcgacctcatgtgccacgccaccttcacgatgcgcctgctgagccccgtgcgggtgccgaactacaacatgatcatcatggacgaggcccacttcaccgacccctccagcatcgcggcccgcggctacatctccacccgggtcgggatgggcgaggccgccgccatcttcatgaccgcgacgccgcccgggagcgtggaggccttcccgcagtccaacgccgtgatccaggacgaggagcgcgacatccccgagcggagctggaactccggccacgagtggatcaccgacttccccggcaagaccgtctggttcgtgcccagcatcaagtccgggaacgacatcgccaactgcctccgcaagaacggcaagcgggtgatccagctgagccgcaagaccttcgacacggagtaccagaagaccaagaacaacgactgggactacgtcgtgaccaccgacatctccgagatgggggcgaacttccgggccgaccgcgtgatcgacccgcggcgctgcctgaagcccgtcatcctcaaggacggccccgagcgggtgatcctggccgggcccatgccggtgacggtcgccagcgccgcgcagcgccggggccgcatcggccggaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtggacggcgagtaccgcctccgcggggaggcccgcaagaccttcgtcgagctgatgcggcgcggcgacctgcccgtgtggctcagctacaaggtggcctccgagggcttccagtacagcgaccggcgctggtgcttcgacggggagcggaacaaccaggtcctggaggagaacatggacgtggagatctggacgaaggagggcgagcgcaagaagctgcggccccgctggctcgacgcccggacctacagcgaccccctggccctgcgcgagttcaaggagttcgcggccgggcggcgctccgtgagcggcgacctcatcctggagatcggcaagctgccgcagcacctcacccagcgggcccagaacgccctggacaacctggtcatgctccacaactccgagcagggcgggcgcgcgtaccggcacgccatggaggagctgcccgacaccatcgagacgctgatgctcctggccctgatcgccgtgctcaccgggggcgtgaccctgttcttcctgagcgggcgcggcctcggcaagacctccatcgggctgctgtgcgtcatggccagctccgtgctcctgtggatggcgagcgtggagccccactggatcgccgcctccatcatcctggagttcttcctcatggtcctgctgatccccgagccggaccggcagcgcacgccccaggacaaccagctcgcctacgtggtgatcggcctgctgttcatgatcctcacggtcgccgcgaacgagatggggctgctggagaccaccaagaaggacctcggcatcgggcacgtggccgtggagaaccaccaccacgccgccatgctggacgtcgacctgcaccccgccagcgcgtggaccctctacgccgtggccacgaccatcatcaccccgatgatgcggcacaccatcgagaacacgaccgccaacatctccctgaccgccatcgcgaaccaggccgccatcctgatgggcctcgacaagggctggcccatcagcaagatggacatcggggtgcccctgctggccctcggctgctactcccaggtcaaccccctgaccctgacggcggccgtgctcatgctggtggcccactacgccatcatcgggccgggcctgcaggccaaggcgacccgcgaggcccagaagcgcaccgccgccgggatcatgaagaaccccaccgtcgacggcatcgtggccatcgacctcgaccccgtggtctacgacgcgaagttcgagaagcagctgggccagatcatgctgctcatcctgtgcacgagccagatcctgctcatgcggaccacctgggccctgtgcgagtccatcaccctggccacggggcccctcaccaccctgtgggagggcagcccggggaagttctggaacaccacgatcgccgtgtccatggccaacatcttccgcggcagctacctggcgggcgccgggctcgccttctccctgatgaagtccctgggcgggggccggcgcgggaccggcgcccagggcgagaccctcggggagaagtggaagcggcagctgaaccagctgagcaagtccgagttcaacacctacaagcgcagcggcatcatggaggtggaccggtccgaggcgaaggaggggctcaagcgcggcgagacgaccaagcacgccgtcagccgggggaccgccaagctgcgctggttcgtggagcggaacctggtgaagcccgagggcaaggtcatcgacctgggctgcgggcgcggcgggtggtcctactactgcgccggcctcaagaaggtgaccgaggtgaaggggtacacgaagggcggccccgggcacgaggagcccatcccgatggccacctacggctggaacctggtcaagctgcacagcgggaaggacgtgttcttcatcccgcccgagaagtgcgacaccctcctgtgcgacatcggcgagtccagccccaacccgaccatcgaggaggggcggacgctgcgcgtgctcaagatggtcgagccctggctgcggggcaaccagttctgcatcaagatcctgaacccctacatgccctccgtggtggagaccctcgagcagatgcagcgcaagcacggcgggatgctggtccggaacccgctgagccgcaactccacccacgagatgtactgggtgagctgcggcaccgggaacatcgtgtccgcggtcaacatgaccagccggatgctcctgaaccgcttcacgatggcccaccgcaagcccacctacgagcgggacgtggacctgggcaccggcacccgccacgtggccgtcgagcccgaggtggccaacctcgacatcatcgggcagcggatcgagaacatcaagcacgagcacaagtccacgtggcactacgacgaggacaacccctacaagacctgggcctaccacggcagctacgaggtgaagccgtccgggagcgcgtccagcatggtcaacggcgtggtcaagctgctgaccaagccctgggacgtgatccccatggtgacccagatcgccatgacggacaccacccccttcgggcagcagcgcgtcttcaaggagaaggtggacacccggacgccgaaggccaagcgcggcaccgcccagatcatggaggtgaccgcccggtggctctggggcttcctgagccgcaacaagaagccccggatctgcacccgcgaggagttcacgcggaaggtccgctccaacgcggccatcggggccgtgttcgtggacgagaaccagtggaacagcgccaaggaggcggtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtcgagggggagggcctccacaagctggggtacatcctgcgcgacatctccaagatccccggcggcaacatgtacgccgacgacaccgccgggtgggacacccggatcacggaggacgacctccagaacgaggccaagatcaccgacatcatggagccggagcacgccctgctggcgaaggccatcttcaagctcacctaccagaacaaggtggtgcgcgtccagcgccccgccaagaacggcaccgtgatggacgtgatcagccggcgcgaccagcgggggtccggccaggtcggcacgtacgggctgaacaccttcaccaacatggaggcccagctgatccgccagatggagagcgagggcatcttctcccccagcgagctcgagacccccaacctggccgagcgggcgctggactggctcgagaagtacggggtggagcgcctgaagcggatggccatctccggcgacgactgcgtggtcaagccgatcgacgaccgcttcgccacggccctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtcgtgccgtgccggaaccaggacgagctggtggggcgcgcgcgggtcagccagggcgccgggtggtccctccgcgagaccgcctgcctgggcaagagctacgcccagatgtggcagctgatgtacttccaccggcgcgacctccggctggcggccaacgccatctgcagcgccgtgcccgtggactgggtccccacctcccgcacgacctggagcatccacgcccaccaccagtggatgaccaccgaggacatgctgtccgtgtggaaccgggtgtggatcgaggagaacccctggatggaggacaagacgcacatcagctcctgggaggacgtcccgtacctcgggaagcgcgaggaccagtggtgcggcagcctgatcggcctgaccgcgcgcgccacctgggccaccaacatccaggtggccatcaaccaggtgcggcgcctcatcgggaacgagaactacctggactacatgacctccatgaagcggttcaagaacgagagcgaccccgagggcgccctgtggtga

SEQ ID NO: 8616 - RNA, 9879 nt, synthetic construct
  misc_feature 1..9879: note = derived and/or modified CDS sequence (opt1) from DENV-1__GU131700__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcccacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctgacggtgagcggcgtgtacccgctctccatccccgccaccctgttcgtctggtacttctggcagaagaagaagcagcgcagcggggtgctgtgggacacccccagcccgcccaaggtggagcgggccgtcctcgacgacggcatctaccgcatcatgcagcggggcctgctggggcgcagccaggtgggcgtgggggtcttccaggagaacgtgttccacaccatgtggcacgtgacgcggggcgccgtcctgatgtaccaggggaagcgcctcgagccctcctgggcgagcgtgaagaaggacctgatctcctacggcggcgggtggcggctgcagggcagctggaacaccggggaggaggtgcaggtcatcgccgtggagcccggcaagaaccccaagaacgtgcagaccgcccccgggaccttcaagacgtccgagggcgaggtcggcgccatcgccctcgacttcaagcccgggaccagcggcagccccatcgtgaaccgcgaggggaagatcgtgggcctgtacggcaacggggtcgtgaccacctccggcacgtacgtgagcgcgatcgcccaggccaaggcctcccaggaggggcccctgccggagatcgaggacgaggtcttccggaagcgcaacctcaccatcatggacctgcaccccggcagcgggaagacccggcgctacctgcccgcgatcgtgcgggaggccatcaagcgcaagctccggaccctgatcctggccccgacgcgcgtggtcgcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtccgcgtgcccaactacaacatgatcatcatggacgaggcccacttcaccgacccgagctccatcgccgcgcgggggtacatcagcacccgcgtgggcatgggggaggccgccgccatcttcatgacggccacgccgcccggctccgtcgaggcgttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagacgttcgacaccgagtaccagaagaccaagaacaacgactgggactacgtggtcaccacggacatcagcgagatgggcgccaacttccgcgcggaccgggtgatcgacccccgccggtgcctcaagccggtgatcctgaaggacgggcccgagcgcgtcatcctggccggccccatgcccgtgaccgtcgcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagacgttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacctactccgaccccctggccctccgggagttcaaggagttcgccgcgggccgccggagcgtctccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacacgatcgagaccatgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagcccgaccgccagcggacgccgcaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgcctccgcctggacgctctacgcggtggccaccaccatcatcacccccatgatgcgccacacgatcgagaacaccaccgccaacatcagcctgaccgccatcgccaaccaggcggccatcctgatggggctcgacaagggctggccgatctccaagatggacatcggcgtccccctgctggccctcgggtgctacagccaggtgaaccccctgacgctgaccgccgcggtgctcatgctggtcgcccactacgccatcatcggccccgggctgcaggccaaggccacccgggaggcgcagaagcgcaccgccgccggcatcatgaagaacccgacggtggacgggatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtcccccggcaagttctggaacacgaccatcgccgtgagcatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgcggtgtcccgcggcaccgccaagctgcggtggttcgtggagcgcaacctggtcaagccggaggggaaggtgatcgacctcggctgcggccgcggcgggtggagctactactgcgccgggctgaagaaggtgacggaggtcaaggggtacaccaagggcggccccggccacgaggagcccatccccatggccacctacgggtggaacctggtgaagctgcactccggcaaggacgtgttcttcatcccgcccgagaagtgcgacaccctcctgtgcgacatcggggagagctcccccaaccccacgatcgaggagggccgcaccctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgccgtgaacatgacgtcccgcatgctcctgaaccggttcaccatggcgcaccgcaagccgacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagcccagcggcagcgcgtccagcatggtgaacggggtcgtgaagctgctgaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgccaagtggctctggggcttcctgtcccgcaacaagaagccgcggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagcccgagcacgccctgctggcgaagtccatcttcaagctcacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctgatccgccagatggagagcgaggggatcttctcccccagcgagctcgagacccccaacctggcccggcgcgtgctggactggctcgagaagcacggcgtcgagcggctgaagcgcatggccatctccggggacgactgcgtggtgaagcccatcgacgaccggttcgcgacggccctgaccgccctcaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctggtgggccgggcccgcgtgtcccagggggccggctggagcctccgggagaccgcgtgcctggggaagtcctacgcccagatgtggcagctgatgtacttccaccgccgggacctccgcctggccgccaacgcgatctgcagcgccgtcccggtggactgggtgcccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccctacctcgggaagcgggaggaccagtggtgcggcagcctgatcggcctgaccgcccgcgccacctgggcgaccaacatccaggtcgccatcaaccaggtgcgccggctcatcgggaacgagaactacctggactacatgacctccatgaagcgcttcaagaacgagagcgacccggagggcgccctgtggtga

SEQ ID NO: 8617 - RNA, 9879 nt, synthetic construct
  misc_feature 1..9879: note = derived and/or modified CDS sequence (opt1) from DENV-1__GU131701__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgaccgccctgttcctggcccacgtgatcggcaccagcatcacgcagaaggggatcatcttcatcctcctgatgctggtcaccccctccatggcgatgcggtgcgtgggcatcggcagccgcgacttcgtggaggggctctccggcgccacctgggtcgacgtggtgctggagcacgggagctgcgtcaccacgatggccaaggacaagcccaccctggacatcgagctcctgaagaccgaggtgaccaaccccgccgtgctgcggaagctctgcatcgaggccaagatctccaacacgaccaccgacagccgctgcccgacccagggcgaggcgacgctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcacggtgcacaccggcgaccagcaccaggtcgggaacgagtccaccgagcacggcaccaccgccacgatcacgccccaggcccccaccaccgagatccagctcacggactacggggcgctgaccctggactgcagcccccgcaccggcctcgacttcaacgagatggtgctgctgaccatgaaggagaagtcctggctcgtgcacaagcagtggttcctggacctgccgctcccctggacgagcggggccagcacctcccaggagacctggaaccggcaggacctgctggtcaccttcaagacggcccacgccaagaagcaggaggtggtggtcctcggcagccaggagggcgccatgcacaccgcgctgaccggggccaccgagatccagacgtccggcaccaccaccatcttcgccgggcacctgaagtgccgcctcaagatggacaagctgacgctgaagggcatgagctacgtgatgtgcaccgggtccttcaagctcgagaaggaggtggccgagacccagcacggcaccgtcctggtgcagatcaagtacgagggcacggacgccccctgcaagatccccttcagcacccaggacgagaagggggtgacccagaacggccggctgatcaccgcgaacccgacggtcaccgacaaggagaagcccgtgaacatcgaggccgagccgcccttcggggagtcctacatcatcatcggcgccggcgagaaggccctgaagctcagctggttcaagaaggggtccagcatcggcaagatgttcgaggcgaccgcccgcggggcccggcgcatggccatcctgggcgacaccgcctgggacttcgggtccatcggcggcgtgttcacgagcgtcgggaagctggtgcaccagatcttcggcaccgcgtacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacctggacggagcagtacaagttccaggccgacagcccgaagcgcctgtccgccgcgatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggccggcatcctcgcccaggggaagaagatgatccggccccagcccatggagtacaagtacagctggaagtcctggggcaaggcgaagatcatcggcgccgacgtgcagaacaccacgttcatcatcgacgggcccaacaccccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacctgcatctggcccaagtcccacaccctgtggagcaacggcgtgctcgagtccgagatgatcatccccaagatctacgggggcccgatcagccagcacaaccaccgccccgggtacttcacgcagaccgcgggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacctggaacgacctgatccgcctctgcatcatggtcggcgccaacgccagcgaccgcatggggatgggcacgacctacctggcgctgatggccaccttcaagatgcggccgatgttcgccgtgggcctcctgttccgccggctgacctcccgcgaggtgctcctgctgacgatcgggctcagcctggtcgcctccgtggagctgcccaacagcctcgaggagctgggcgacgggctggccatgggcatcatgatcctcaagctgctgaccgacttccagccccaccagctctgggcgaccctgctgtccctcaccttcatcaagacgaccttcagcctgcactacgcctggaagaccatggccatggtcctgtccatcgtgagcctcttccccctgtgcctgtccaccacgagccagaagaccacctggctcccggtgctgctgggctccctcgggtgcaagcccctgaccatgttcctgatcgccgagaacaagatctggggccggcgcagctggcccctcaacgaggggatcatggcggtcggcatcgtgtccatcctgctgagcagcctcctgaagaacgacgtgcccctggccgggccgctcatcgccggcggcatgctgatcgcctgctacgtcatctccgggagctccgccgacctgagcctcgagaaggcggccgaggtgtcctgggaggaggaggccgagcacagcggcgcctcccacaacatcctggtggaggtccaggacgacgggaccatgaagatcaaggacgaggagcgggacgacacgctgaccatcctcctgaaggccaccctgctcgcggtgagcggcgtgtaccccctgtccatccccgccaccctgttcgtctggtacttctggcagaagaagaagcagcgcagcggggtgctctgggacacgccctccccgcccgaggtggagcgggccgtcctggacgacggcatctaccgcatcatgcagcggggcctgctggggcgcagccaggtgggcgtgggggtcttccaggagaacgtgttccacaccatgtggcacgtgacccggggcgccgtcctcatgtaccaggggaagcgcctggagccctcctgggccagcgtgaagaaggacctgatctcctacggcggcgggtggcggctccagggcagctggaacaccggggaggaggtgcaggtcatcgcggtggagcccggcaagaacccgaagaacgtgcagacggcccccgggaccttcaagacccccgagggcgaggtcggcgccatcgccctggacttcaagcccgggacctccggcagcccgatcgtgaaccgcgaggggaagatcgtgggcctgtacggcaacggggtcgtgacgacctccggcacctacgtgagcgccatcgcgcaggccaaggccagccaggaggggcccctccccgagatcgaggacgaggtcttccggaagcgcaacctgaccatcatggacctgcacccgggctccgggaagacgcggcgctacctccccgccatcgtgcgggaggcgatcaagcgcaagctgcgcaccctgatcctcgcccccacccgggtggtcgccagcgagatggccgaggccctgaagggcatgcccatccgctaccagaccacggcggtgaagtccgagcacaccggcaaggagatcgtggacctgatgtgccacgccaccttcaccatgcggctcctgagcccggtccgcgtgcccaactacaacatgatcatcatggacgaggcccacttcacggacccctccagcatcgccgcccgggggtacatctccacccgcgtgggcatgggggaggcggccgccatcttcatgaccgccacgccgcccggcagcgtcgaggccttcccccagtccaacgcggtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgccaacttccgcgccgaccgggtgatcgacccccgccggtgcctgaagcccgtgatcctgaaggacgggcccgagcgcgtcatcctcgcgggcccgatgcccgtgaccgtcgccagcgccgcccagcggcgcgggcggatcggccgcaaccacaacaaggagggcgaccagtacatctacatggggcagcccctgaacaacgacgaggaccacgcccactggacggaggcgaagatgctgctcgacaacatcaacacccccgagggcatcatcccggccctgttcgagcccgagcgcgagaagtccgccgccatcgacggggagtaccggctgcgcggcgaggcccggaagaccttcgtggagctcatgcgccgcggggacctgcccgtgtggctgagctacaaggtcgcgtccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtacagcgacccgctcgccctgcgggagttcaaggagttcgccgccggccgccggtccgtcagcggggacctgatcctcgagatcggcaagctgccccagcacctgacccagcgcgcgcagaacgccctcgacaacctggtgatgctgcacaactccgagcagggcgggcgggcctaccgccacgccatggaggagctccccgacaccatcgagaccctgatgctgctcgcgctgatcgccgtgctgaccggcggggtcaccctcttcttcctgagcggccgggggctgggcaagacctccatcggcctcctgtgcgtgatggccagctccgtgctgctctggatggccagcgtcgagccccactggatcgccgcgtccatcatcctggagttcttcctgatggtgctcctgatcccggagcccgaccgccagcggacgccccaggacaaccagctggcctacgtggtcatcgggctcctgttcatgatcctgaccgtggccgccaacgagatgggcctcctggagacgaccaagaaggacctggggatcggccacgtggccgtcgagaaccaccaccacgcggccatgctcgacgtggacctgcacccggccagcgcctggaccctgtacgccgtggcgaccacgatcatcacccccatgatgcgccacaccatcgagaacaccacggccaacatctccctcaccgccatcgccaaccaggccgcgatcctgatggggctggacaagggctggcccatcagcaagatggacatcggcgtccccctcctggccctggggtgctactcccaggtgaacccgctcaccctgaccgccgccgtgctgatgctcgtcgcgcactacgccatcatcggccccgggctgcaggccaaggccacgcgcgaggcccagaagcggaccgcggccggcatcatgaagaaccccaccgtggacgggatcgtggccatcgacctggaccccgtcgtgtacgacgccaagttcgagaagcagctcggccagatcatgctgctgatcctctgcaccagccagatcctgctgatgcgcacgacctgggccctctgcgagtccatcaccctggcgaccggcccgctgacgaccctctgggaggggagccccggcaagttctggaacaccaccatcgccgtgtccatggccaacatcttccgggggagctacctggccggcgccggcctggcgttctccctcatgaagtccctcgggggcgggcgccgggggacgggggcccagggcgagaccctgggcgagaagtggaagcgccagctcaaccagctgagcaagtccgagttcaacacctacaagcggagcgggatcatggaggtcgaccgctccgaggccaaggagggcctgaagcgcggggagaccacgaagcacgccgtgagccgcggcaccgcgaagctccggtggttcgtggagcgcaacctggtcaagcccgaggggaaggtgatcgacctgggctgcggccgcggcgggtggtcctactactgcgccgggctgaagaaggtgaccgaggtcaaggggtacaccaagggcggccccggccacgaggagccgatccccatggccacgtacgggtggaacctcgtgaagctgcacagcggcaaggacgccttcttcatcccgcccgagaagtgcgacaccctgctctgcgacatcggggagtccagcccgaaccccaccatcgaggagggccgcaccctgcgggtgctgaagatggtcgagccctggctccgcgggaaccagttctgcatcaagatcctgaacccctacatgccgtccgtggtggagaccctggagcagatgcagcggaagcacggcggcatgctcgtccgcaaccccctgagccggaactccacgcacgagatgtactgggtgagctgcgggaccggcaacatcgtgtccgccatcaacatgaccagccgcatgctgctcaaccgcttcaccatggcgcaccggaagcccacgtacgagcgcgacgtcgacctgggggccggcacccggcacgtggccgtggagcccgaggtcgccaacctggacatcatcggccagcgcatcgagaacatcaagcacgagcacaagtccacctggcactacgacgaggacaacccgtacaagacctgggcctaccacgggagctacgaggtgaagccctccggcagcgcgtccagcatggtgaacggggtcgtgaagctcctgacgaagccctgggacgtcatccccatggtgacccagatcgccatgaccgacaccacgccgttcggccagcagcgggtgttcaaggagaaggtcgacacccgcacccccaaggccaagcgggggaccgcccagatcatggaggtgacggccaagtggctgtggggcttcctcagccgcaacaagaagccccggatctgcacccgcgaggagttcacccggaaggtgcgctccaacgcggccatcggcgccgtcttcgtggacgagaaccagtggaacagcgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcaccgcctcggctacatcctgcgggacatctccaagatccccgggggcaacatgtacgccgacgacacggccggctgggacacccgcatcaccgaggacgacctgcagaacgaggcccgcatcaccgacatcatggagcccgagcacgccctcctggccaagagcatcttcaagctgacgtaccagaacaaggtcgtgcgggtgcagcgccccgggaagaacggcaccgtcatggacgtgatctcccggcgcgaccagcgggggagcggccaggtgggcacctacgggctcaacaccttcacgaacatggaggcccagctgatccgccagatggagtccgagggcatcttcagcccctccgagctggagaccccgaacctcgccgagcgggtcctggactggctggagaagtacggggtggagcgcctcaagcggatggccatcagcggcgacgactgcgtggtcaagcccatcgacgaccgcttcgccaccgcgctgaccgccctgaacgacatggggaaggtgcggaaggacatcccccagtgggagccctccaagggctggaacgactggcagcaggtcccgttctgcagccaccacttccaccagctcatcatgaaggacggccgcgagatcgtcgtgccctgccggaaccaggacgagctggtggggcgcgcccgggtctcccagggcgccgggtggagcctgcgcgagacggcctgcctcggcaagagctacgcgcagatgtggcagctgatgtacttccaccggcgcgacctgcggctcgccgccaacgccatctgctccgcggtgcccgtggactggatccccaccagccgcaccacctggtccatccacgcccaccaccagtggatgacgaccgaggacatgctgagcgtctggaaccgcgtgtggatcgaggagaacccgtggatggaggacaagacccacatctccagctggggcgacgtgccctacctgggcaagcgggaggaccagtggtgcggctccctcatcgggctgaccgcccgcgccacctgggccacgaacatccaggtcgcgatcaaccaggtgcggcgcctgatcggcaacgagaactacctcgactacatgaccagcatgaagcggttcaagaacgagtccgaccccgagggggccctgtggtga

SEQ ID NO: 8618 - RNA, 9879 nt, synthetic construct
  misc_feature 1..9879: note = derived and/or modified CDS sequence (opt1) from DENV-1__GU131703__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcacgctcatcctggcccccacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctcaaggacgggcccgagcgcgtgatcctggcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtcatgctccacaacagcgagcagggcgggcgggcctaccgccacgccatggaggagctgcccgacaccatcgagaccctgatgctcctggcgctgatcgccgtgctcaccggcggggtgaccctgttcttcctgtccggccgggggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcggacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcacggggaacatcgtgagcgccgtcaacatgacctcccgcatgctcctgaaccgcttcaccatggcccaccggaagcccacctacgagcgcgacgtggacctgggcgcgggcacgcggcacgtggccgtcgagcccgaggtggccaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgggtcttcaaggagaaggtggacacgcgcaccccgaaggccaagcggggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtggtgcgcgtccagcggcccgcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccaacctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgaccccgagggggccctgtggtga

SEQ ID NO: 8619 - RNA, 9879 nt, synthetic construct
  misc_feature 1..9879: note = derived and/or modified CDS sequence (opt1) from DENV-1__GU131706__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttccgcaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcatgacctacctggccctgatggccaccttcaagatgcgcccgatgttcgccgtgggcctcctgttccggcgcctgacgtcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccttctccctgcactacgcctggaagaccatggccatggtcctgagcatcgtgtccctcttccccctgtgcctgagcacgacctcccagaagaccacctggctccccgtgctgctgggcagcctcgggtgcaagccgctgacgatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgccgtcctcatgtaccaggggaagcggctggagcccagctgggcgtccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgggaggggaagatcgtgggcctgtacggcaacggggtcgtgaccaccagcggcacctacgtgagcgcgatcgcccaggccaaggcctcccaggaggggccgctccccgagatcgaggacgaggtcttccgcaagcggaacctgacgatcatggacctgcaccccggcagcgggaagacccgccggtacctcccggcgatcgtgcgcgaggccatcaagcgcaagctgcggaccctgatcctcgcccccacccgcgtggtcgcctccgagatggccgaggcgctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgaccgccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgccaacttccgggcggaccgcgtgatcgacccgcggcgctgcctgaagcccgtgatcctgaaggacgggcccgagcgggtcatcctcgccggccccatgccggtgacggtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgacggtggccgccaacgagatgggcctcctggagaccaccaagaaggacctggggatcggccacgtggcggtcgagaaccaccaccacgccgccatgctcgacgtggacctgcaccccgcctccgcctggaccctgtacgcggtggccacgaccatcatcaccccgatgatgcgccacaccatcgagaacacgaccgccaacatcagcctcaccgccatcgccaaccaggcggccatcctgatggggctggacaagggctggcccatctccaagatggacatcggcgtccccctcctggccctggggtgctacagccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcggaccacctgggcgctctgcgagagcatcaccctggccacgggccccctgaccaccctctgggaggggtccccgggcaagttctggaacaccacgatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggccaaggagggcctgaagcgcggggagacgaccaagcacgcggtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacctcccgcatgctgctcaaccggttcacgatggcgcaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgcgagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgccaagtggctgtggggcttcctctcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtgggcacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8620 - RNA, 9879 nt, synthetic construct
  misc_feature 1..9879: note = derived and/or modified CDS sequence (opt1) from DENV-1__GU131708__SS-prME
  source 1..9879: mol_type = other RNA
agcgtgaccatgctgctcatgctgatgcccaccgccctggccttccacctcaccacccggggcggggagccccacatggtggtgtccaagcaggagcggggcaagagcctgctgttcaagacctccgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcacctccagcttcaagctcgagaaggaggtggcggagacgcagcacgggaccgtgctggtccagatcaagtacgagggcaccgacgccccctgcaagatccccttctccacccaggacgagaagggcgtgacgcagaacgggcggctgatcaccgccaacccgatcgtgaccgacaaggagaagcccgtcaacatcgaggccgagccgcccttcggcgagagctacatcgtgatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtcggcaagctggtgcaccagatcttcgggaccgcctacggcgtcctgttcagcggggtctcctggaccatgaagatcggcctgggggtgctgctcacgtggctgggcctgaacagccgctccaccagcctctccatgacctgcatcgccgtgggcctggtcaccctgtacctcggggtgatggtgcaggccgacagcggctgcgtcatcaactggaaggggcgggagctgaagtgcggcagcgggatcttcgtgacgaacgaggtgcacacctggaccgagcagtacaagttccaggcggactccccgaagcgcctgagcgccgccatcggcaaggcctgggaggagggcgtctgcgggatccggtccgccacccgcctcgagaacgtgatgtggaagcagatcagcaacgagctgaaccacatcctgctcgagaacgacatgaagttcaccgtggtcgtgggcgacgtggcggggatcctggcccagggcaagaagatgatccggccccagcccatggagtacaagtactcctggaagtcctgggggaaggccaagatcatgggcgccgacgtccagaacacgaccttcatcatcgacggccccaacaccccggagtgccccgacgaccagcgcgcgtggaacatctgggaggtggaggactacgggttcggcatcttcaccacgaacatctggctgaagctccgggactcctacacccaggtgtgcgaccaccgcctgatgagcgccgccatcaaggactccaaggccgtccacgccgacatggggtactggatcgagagcgagaagaacgagacctggaagctggcgcgggcctccttcatcgaggtgaagacctgcatctggcccaagagccacacgctctggtccaacggcgtgctggagagcgagatgatcatccccaagatctacggcgggccgatctcccagcacaactaccgccccggctacttcacccagaccgccgggccctggcacctgggcaagctcgagctggacttcgacctgtgcgaggggaccacggtcgtggtggacgagcactgcggcaaccggggcccgagcctccgcaccaccaccgtcacggggaagatcatccacgagtggtgctgccggtcctgcaccctgccgcccctgcgcttccggggcgaggacgggtgctggtacggcatggagatccgccccgtgaaggagaaggaggagaacctcgtcaagagcatggtcagcgccgggtccggcgaggtggacagcttctccctgggcctgctctgcatcagcatcatgatcgaggaggtgatgcggtcccgctggagccggaagatgctgatgaccgggaccctggccgtcttcctcctgctgatcatgggccagctcacgtggaacgacctgatccgcctgtgcatcatggtgggggcgaacgcctccgaccgcatgggcatggggaccacctacctcgccctgatggccaccttcaagatgcggccgatgttcgccgtggggctcctgttccgccggctgacgagccgcgaggtcctgctcctgaccatcggcctgtccctcgtggcgagcgtcgagctgcccaactccctggaggagctcggggacggcctggccatggggatcatgatcctgaagctcctgaccgacttccagagccaccagctgtgggccaccctcctgtccctgacgttcatcaagaccaccttcagcctccactacgcctggaagaccatggcgatggtgctgtccatcgtgagcctgttccccctctgcctgtccacgaccagccagaagaccacctggctgcccgtcctcctgggctccctgggctgcaagccgctcacgatgttcctgatcgccgagaacaagatctgggggcggcgcagctggcccctgaacgagggcatcatggccgtggggatcgtgagcatcctcctgtccagcctgctcaagaacgacgtccccctggccggccccctgatcgccgggggcatgctcatcgcgtgctacgtgatctccggcagctccgccgacctgagcctggagaaggccgccgaggtgtcctgggaggaggaggccgagcacagcggggcgtcccacaacatcctcgtcgaggtgcaggacgacggcaccatgaagatcaaggacgaggagcgggacgacaccctgaccatcctgctcaaggccaccctgctggccgtgagcggggtctacccgctctccatccccgccacgctgttcgtgtggtacttctggcagaagaagaagcagcgcagcggcgtgctgtgggacacccccagcccgcccgaggtcgagcgggccgtgctggacgacgggatctaccgcatcatgcagcggggcctcctgggccgcagccaggtgggggtcggcgtgttccaggagaacgtgttccacaccatgtggcacgtcacccgcggggcggtgctgatgtaccagggcaagcgcctcgagccctcctgggccagcgtgaagaaggacctgatctcctacgggggcggctggcggctgcaggggagctggaacacgggcgaggaggtccaggtgatcgccgtggagcccgggaagaaccccaagaacgtccagaccgcccccggcaccttcaagacccccgagggggaggtgggcgccatcgcgctcgacttcaagcccggcacgtccgggagccccatcgtgaaccgcgagggcaagatcgtcgggctgtacggcaacggcgtggtgaccaccagcgggacctacgtctccgccatcgcccaggccaaggcgagccaggagggcccgctgcccgagatcgaggacgaggtgttccggaagcgcaacctcacgatcatggacctgcaccccgggtccggcaagacccggcgctacctgccggccatcgtgcgggaggccatcaagcgcaagctccgcaccctgatcctggcccccacccgggtcgtggccagcgagatggcggaggccctcaaggggatgcccatccgctaccagacgaccgccgtgaagtccgagcacaccggcaaggagatcgtcgacctgatgtgccacgccaccttcacgatgcggctgctcagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggctacgagtggatcaccgacttccccgggaagaccgtctggttcgtgcccagcatcaagtccggcaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctcaagcccgtcatcctgaaggacggccccgagcgcgtgatcctggccgggcccatgccggtcacggtggccagcgccgcgcagcggcgcggccggatcgggcgcaaccacaacaaggagggcgaccagtacatctacatgggccagcccctcaacaacgacgaggaccacgcccactggaccgaggccaagatgctgctggacaacatcaacacccccgaggggatcatccccgccctcttcgagccggagcgcgagaagtccgccgcgatcgacggcgagtaccggctgcgcggggaggcccggaagaccttcgtggagctgatgcgccggggcgacctccccgtctggctgagctacaaggtggccagcgaggggttccagtactccgaccgccggtggtgcttcgacggcgagcgcaacaaccaggtgctggaggagaacatggacgtcgagatctggacgaaggagggcgagcggaagaagctccgcccccggtggctggacgcccgcacctacagcgaccccctggccctccgggagttcaaggagttcgcggccgggcgccggtccgtgagcggcgacctgatcctggagatcgggaagctcccgcagcacctgacccagcgcgcccagaacgccctggacaacctcgtgatgctgcacaactccgagcagggcggccgggcgtaccgccacgccatggaggagctgcccgacaccatcgagacgctcatgctgctggccctcatcgccgtcctgaccgggggcgtgaccctgttcttcctcagcgggcggggcctggggaagacctccatcggcctgctctgcgtgatggccagctccgtcctgctgtggatggcgagcgtggagccccactggatcgccgcctccatcatcctcgagttcttcctgatggtgctgctcatccccgagccggaccgccagcggacgccccaggacaaccagctggcctacgtcgtgatcggcctcctcttcatgatcctgacggtggccgcgaacgagatggggctgctcgagaccaccaagaaggacctgggcatcgggcacgccgccgtcggcaaccaccaccacgccgccatgctggacgtggacctccaccccgcgagcgcctggaccctgtacgccgtggccacgaccatcatcaccccgatgatgcgccacaccatcgagaacacgaccgccaacatctccctgaccgcgatcgccaaccaggccgccatcctcatggggctggacaagggctggcccatcagcaagatggacatcggcgtccccctgctcgcgctggggtgctactcccaggtgaaccccctgaccctcacggccgccgtgctgatgctggtcgcccactacgccatcatcggcccggggctccaggcgaaggccacccgcgaggcccagaagcggaccgccgccggcatcatgaagaaccccaccgtggacgggatcgtggcgatcgacctggaccccgtcgtgtacgacgccaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagcccgggcaagttctggaacaccacgatcgccgtgtccatggcgaacatcttccgggggagctacctcgccggcgccggcctggccttcagcctgatgaagtccctcgggggcgggcgccggggcaccggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagacgaccaagcacgccgtgagccgcggcaccgccaagctgcggtggttcgtggagcgcaacctggtcaagcccgaggggaaggtgatcgacctcggctgcggccgcggcgggtggtcctactactgcgccgggctgaagaaggtgaccgaggtcaaggggtacacgaagggcgggcccggccacgaggagcccatcccgatggcgacctacgggtggaacctggtgaagctccacagcggcaaggacgtgttcttcatcccgcccgagaagtgcgacaccctgctgtgcgacatcggggagtccagccccaacccgaccatcgaggagggccgcacgctccgggtcctgaagatggtggagccctggctgcgcgggaaccagttctgcatcaagatcctcaacccctacatgccctccgtggtcgagaccctggagcagatgcagcggaagcacggcggcatgctggtgcgcaacccgctcagccggaactccacccacgagatgtactgggtgagctgcgggaccggcaacatcgtctccgccgtgaacatgaccagccgcatgctgctgaaccgcttcacgatggcccaccggaagcccacctacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacgtgggcctaccacgggagctacgaggtcaagccgtccggcagcgccagctccatggtgaacggggtcgtgaagctgctcaccaagccctgggacgtgatccccatggtcacccagatcgccatgaccgacacgacccccttcggccagcagcgggtgttcaaggagaaggtggacacccgcaccccgaaggccaagcgggggacggcgcagatcatggaggtcaccgccaagtggctgtggggcttcctgagccgcaacaagaagccccggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcaccgaggacgacctgcagaacgaggcgcgcatcacggacatcatggagccggagcacgccctgctcgccaagagcatcttcaagctgacctaccagaacaaggtggtccgcgtgcagcggcccgccaagaacgggaccgtgatggacgtcatctcccgccgggaccagcgcggcagcggccaggtgggcacctacggcctgaacacgttcaccaacatggaggcccagctcatccggcagatggagtccgaggggatcttcagcccctccgagctggagacccccaacctggcggagcgcgtgctcgactggctggagaagtacggcgtcgagcggctgaagcgcatggccatcagcggggacgactgcgtggtgaagccgatcgacgaccggttcgccaccgccctcacggccctgaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctcgtgggccgggcgcgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactggatccccaccagccggaccacgtggtccatccacgcccaccaccagtggatgaccaccgaggacatgctcagcgtgtggaaccgcgtctggatcgaggagaacccctggatggaggacaagacccacatctccagctggggcgacgtgccgtacctggggaagcgcgaggaccagtggtgcggctccctgatcggcctcacggcgcgggccacctgggccaccaacatccaggtggccatcaaccaggtccgccggctgatcgggaacgagaactacctggactacatgaccagcatgaagcgcttcaagaacgagtccgaccccgagggcgccctctggtga

SEQ ID NO: 8621 - RNA, 9879 nt, synthetic construct
  misc_feature 1..9879: note = derived and/or modified CDS sequence (opt1) from DENV-1__GU131710__SS-prME
  source 1..9879: mol_type = other RNA
agcgtgaccatgctgctcatgctgatgcccaccgccctggccttccacctcaccacccggggcggggagccccacatgatcgcgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtggagacgtgggccctccggcaccccgggttcaccgtcatcgccctgttcctggcgcacgccatcggcaccagcatcacccagaaggggatcatcttcatcctcctgatgctggtgacgccctccatggccatgcggtgcgtgggcatcggcagccgcgacttcgtcgaggggctctccggcgccacctgggtggacgtggtcctggagcacgggagctgcgtgaccaccatggccaaggacaagcccacgctggacatcgagctcctgaagaccgaggtgaccaaccccgcggtcctgcggaagctctgcatcgaggccaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgcgaccatcacgccccaggcccccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgcgaagaagcaggaggtggtcgtgctcggcagccaggagggcgccatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgcggagacccagcacggcaccgtgctggtgcagatcaagtacgagggcaccgacgccccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcatcacgctgtacctgggcgtgatggtccaggccgactccgggtgcgtgatcaactggaagggccgggagctcaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcacggtggtcgtgggggacgtggcgggcatcctcgcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctgcgggacagctacacccaggtgtgcgaccaccgcctcatgtccgccgccatcaaggacagcaaggccgtccacgccgacatgggctactggatcgagtccgagaagaacgagacctggaagctggcgcgggccagcttcatcgaggtgaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttccgcggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggcgcatgctcatgaccggcaccctggcggtcttcttcctgctcatcatggggcagctgacgtggaacgacctgatccgcctctgcatcatggtgggcgccaacgccagcgaccggatggggatgggcaccacctacctggccctgatggccaccttcaagatgcgcccgatgttcgcggtgggcctcctgttccggcgcctgacgtcccgggaggtcctcctgctgaccatcgggctcagcctggtggcctccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcgtggaagaccatggccatggtcctgagcatcgtgtccctcttccccctgtgcctgagcacgacctcccagaagaccacctggctccccgtcctgctgggcagcctcgggtgcaagccgctgacgatgttcctgatcgccgagaacaagatctggggccgccggtcctggcccctcaacgaggggatcatggccgtgggcatcgtgagcatcctgctgagctccctcctgaagaacgacgtccccctggccgggcccctcatcgcgggcggcatgctgatcgcctgctacgtgatcagcgggtccagcgccgacctgtccctcgagaaggccgccgaggtgagctgggaggaggaggcggagcactccggcgccagccacaacatcctggtcgaggtgcaggacgacgggaccatgaagatcaaggacgaggagcgcgacgacaccctgaccatcctcctgaaggccaccctgctcgccgtgtccggcgtctacccgctgagcatccccgccacgctgttcgtgtggtacttctggcagcggaagaagcagcgctccggggtgctctgggacacccccagcccgcccgaggtcgagcgggcggtgctggacgacggcatctaccgcatcatgcagcggggcctgctggggcgctcccaggtgggcgtcggggtgttccaggagaacgtgttccacaccatgtggcacgtcacccggggcgccgtgctcatgtaccaggggaagcgcctggagcccagctgggcctccgtgaagaaggacctgatcagctacggcggcgggtggcggctccagggctcctggaacacgggggaggaggtccaggtgatcgccgtggagcccggcaagaaccccaagaacgtccagaccgcccccgggaccttcaagacccccgagggcgaggtgggcgcgatcgccctggacttcaagcccgggacgagcggctcccccatcgtgaaccgcgaggggaagatcgtcggcctgtacggcaacggggtggtgaccaccagcggcacctacgtcagcgccatcgcccaggcgaaggcctcccaggaggggccgctccccgagatcgaggacgaggtgttccggaagcgcaacctgacgatcatggacctgcaccccggcagcgggaagacccggcgctacctcccggccatcgtgcgcgaggccatcaagcggaagctgcgcaccctgatcctcgcccccacccgggtcgtggcgtccgagatggccgaggccctgaagggcatgcccatccgctaccagacgaccgccgtcaagagcgagcacaccggcaaggagatcgtcgacctgatgtgccacgccaccttcacgatgcggctcctgtcccccgtgcgcgtgccgaactacaacatgatcatcatggacgaggcgcacttcaccgaccccagctccatcgccgcccgggggtacatcagcacccgcgtcggcatgggggaggccgccgcgatcttcatgaccgccacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgcgaactgcctgcggaagaacgggaagcgcgtgatccagctctcccggaagaccttcgacacggagtaccagaagaccaagaacaacgactgggactacgtcgtgaccaccgacatcagcgagatgggcgccaacttccgcgccgaccgggtgatcgacccgcgccggtgcctgaagcccgtcatcctgaaggacgggcccgagcgcgtgatcctcgccggccccatgccggtgacggtcgcctccgcggcccagcggcgcgggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccggctgcgcggcgaggcccggaagaccttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctactccgaccccctcgcgctgcgggagttcaaggagttcgccgccggccgccggagcgtgtccggggacctgatcctcgagatcggcaagctgccgcagcacctgacccagcgcgcccagaacgcgctcgacaacctggtgatgctgcacaacagcgagcagggcgggcgggcctaccgccacgccatggaggagctccccgacaccatcgagacgctgatgctgctcgccctgatcgccgtcctgaccggcggggtgaccctcttcttcctgtccggccgggggctgggcaagaccagcatcggcctcctgtgcgtgatggcgtccagcgtcctgctctggatggcctccgtggagccccactggatcgccgccagcatcatcctggagttcttcctgatggtgctcctgatccccgagccggaccgccagcgcacgccccaggacaaccagctggcctacgtcgtgatcgggctcctgttcatgatcctgacggtggcggccaacgagatgggcctcctggagaccaccaagaaggacctggggatcggccacgtcgccgtggagaaccaccaccacgccgccatgctcgacgtggacctgcaccccgcgtccgcctggaccctgtacgccgtcgccacgaccatcatcaccccgatgatgcggcacaccatcgagaacacgaccgccaacatcagcctcaccgcgatcgccaaccaggccgccatcctgatggggctggacaagggctggcccatctccaagatggacatcggcgtgcccctcctggcgctggggtgctacagccaggtgaaccccctcaccctgacggccgccgtcctgatgctcgtggcccactacgccatcatcggcccggggctgcaggcgaaggccacccgcgaggcccagaagcggaccgccgccggcatcatgaagaaccccaccgtggacgggatcgtcgcgatcgacctggaccccgtggtgtacgacgccaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtcagcatggcgaacatcttccgggggtcctacctggccggcgccggcctggccttcagcctcatgaagtccctcgggggcgggcgccgggggaccggggcgcagggcgagaccctgggcgagaagtggaagcgccagctcaaccagctgtccaagagcgagttcaacacctacaagcggtccgggatcatggaggtggaccgcagcgaggccaaggagggcctgaagcgcggggagacgaccaagcacgccgtgtcccgcggcaccgccaagctccggtggttcgtcgagcgcaacctggtgaagcccgaggggaaggtgatcgacctgggctgcggccgcgggggctggagctactactgcgccgggctgaagaaggtcaccgaggtgaagggctacacgaagggcggccccggccacgaggagcccatcccgatggcgacctacgggtggaacctcgtgaagctgcactccggcaaggacgtcttcttcatcccgcccgagaagtgcgacaccctgctctgcgacatcggggagagctcccccaacccgaccatcgaggagggccgcacgctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccgcaacagcacccacgagatgtactgggtctcctgcgggaccggcaacatcgtgagcgccgtgaacatgacctcccggatgctgctcaaccgcttcacgatggcccaccggaagcccacctacgagcgcgacgtcgacctgggggccggcacccggcacgtggccgtggagcccgaggtcgcgaacctggacatcatcggccagcgcatcgagaacatcaagcacgagcacaagagcacctggcactacgacgaggacaacccctacaagacgtgggcctaccacgggtcctacgaggtgaagccgagcggctccgccagcagcatggtgaacggggtcgtgaagctcctgaccaagccctgggacgtcatccccatggtgacccagatcgccatgaccgacacgacccccttcggccagcagcgggtgttcaaggagaaggtcgacacccgcaccccgaaggccaagcgggggacggcgcagatcatggaggtgaccgccaagtggctgtggggcttcctctcccgcaacaagaagccccggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccgcatcaccgaggacgacctgcagaacgaggcgcggatcacggacatcatggagccggagcacgccctcctggccaagtccatcttcaagctgacctaccagaacaaggtcgtgcgcgtgcagcggcccgccaagaacgggaccgtcatggacgtgatcagccgccgggaccagcgcggctccggccaggtggggacctacggcctcaacacgttcaccaacatggaggcccagctgatccggcagatggagagcgaggggatcttctcccccagcgagctggagacccccaacctcgcggagcgcgtcctggactggctggagaagtacggcgtggagcggctcaagcgcatggccatctccggggacgactgcgtggtcaagccgatcgacgaccggttcgccaccgccctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcgcgcgtcagccagggggccggctggagcctgcgggagaccgcctgcctcgggaagtcctacgcccagatgtggcagctgatgtacttccaccgccgggacctgcgcctcgcggccaacgccatctgcagcgccgtgcccgtggactggatccccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccgtacctggggaagcgcgaggaccagtggtgcggcagcctcatcggcctgacggcgcgggccacctgggccaccaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8622 - RNA, 9879 nt, synthetic construct
  misc_feature 1..9879: note = derived and/or modified CDS sequence (opt1) from DENV-1__GU131717__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatgacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaagaccctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggccgactccccgaagcgcctcagcgcggccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggccggcatcctggcgcaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggactcctacacccaggtgtgcgaccaccgcctgatgagcgcggccatcaaggactccaaggccgtgcacgccgacatgggctactggatcgagagcgagaagaacgagacctggaagctcgcccgggcgtccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccttcagcctccactacgcctggaagaccatggccatggtcctgtccatcgtgagcctgttccccctctgcctgtccacgaccagccagaagaccacctggctgcccgtgctcctgggctccctggggtgcaagccgctcacgatgttcctgatcgcggagaacaagatctggggccgcaagagctggcccctgaacgaggggatcatggccgtcggcatcgtgagcatcctcctgtccgccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgaccatcctgctcaaggccaccctgctggccgtgtccggcgtgtacccgctcagcatccccgccacgctgttcgtctggtacttctggcagaagaagaagcagcgctccggggtgctgtgggacacccccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgcggtcctgatgcaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagaccagcgagggcgaggtcggcgccatcgcgctcgacttcaagcccgggacgtccggcagccccatcgtgaaccgcgaggggaagatcgtgggcctgtacggcaacggggtcgtgaccaccagcggcacctacgtgtccgccatcgcccaggccaaggcgagccaggaggggcccctgccggagatcgaggacgaggtcttccggaagcgcaacctcacgatcatggacctgcaccccggctccgggaagacccggcgctacctgcccgccatcgtgcgggaggccatcaagcgcaagctccggaccctgatcctggccccgacccgcgtggtcgccagcgagatggcggaggccctcaagggcatgcccatccgctaccagacgaccgccgtgaagtccgagcacaccggcaaggagatcgtggacctgatgtgccacgccaccttcacgatgcggctgctcagccccgtccgcgtgcccaactacaacatgatcatcatggacgaggcccacttcaccgacccgtccagcatcgcggcccgggggtacatctccacccgcgtgggcatgggggaggccgccgccatcttcatgaccgcgacgccgcccggcagcgtcgaggccttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagaccttcgacacggagtaccagaagaccaagaacaacgactgggactacgtggtcaccaccgacatctccgagatgggcgcgaacttccgcgccgaccgggtgatcgacccccgccggtgcctcaagccggtgatcctgaaggacgggcccgagcgcgtcatcctggccggccccatgcccgtgacggtcgccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggacgaaggagggggagcggaagaagctccgcccccggtggctggacgcccgcacctacagcgaccccctggccctccgggagttcaaggagttcgcggccggccgccggtccgtcagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacaccatcgagacgctcatgctgctggccctcatcgccgtgctgaccggcggggtcaccctgttcttcctcagcggccgggggctgggcaagacctccatcggcctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgccagcgcgtggaccctgtacgccgtggccacgaccatcatcacccccatgatgcgccacaccatcgagaacacgaccgccaacatctccctgaccgccatcgcgaaccaggccgccatcctcatggggctggacaagggctggccgatcagcaagatggacatcggcgtccccctgctcgccctggggtgctactcccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgccgtgtccatggccaacatcttccgggggagctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacctacaagcggagcgggatcatggaggtcgaccgctccgaggcgaaggagggcctgaagcgcggggagacgaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacacgaagggcgggcccggccacgaggagcccatccccatggccacctacgggtggaacctggtgaagctccacagcggcaaggacgtgttcttcatcccgcccgagaagtgcgacaccctgctgtgcgacatcggggagtccagccccaaccccaccatcgaggagggccgcacgctccgggtcctgaagatggtggagccgtggctgcgcgggaaccagttctgcatcaagatcctcaacccctacatgccctccgtggtcgagaccctggagcagatgcagcggaagcacggcggcatgctggtgcgcaaccccctcagccggaactccacccacgagatgtactgggtgagctgcgggaccggcaacatcgtctccgcggtgaacatgaccagccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagtccacctggcactacgacgaggacaacccctacaagacgtgggcgtaccacgggagctacgaggtcaagccctccggcagcgccagctccatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgagccgcaacaagaagccgcggatctgcacccgcgaggagttcacccggaaggtgcgctccaacgccgccatcggcgccgtgttcgtcgacgagaaccagtggaacagcgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcaccgaggacgacctgcagaacgaggccaagatcacggacatcatggagcccgagcacgcgctgctcgccaagagcatcttcaagctgacctaccagaacaaggtggtccgcgtgcagcggccggccaagaacgggaccgtgatggacgtcatctcccgccgcgaccagcggggcagcggccaggtgggcacctacggcctgaacacgttcaccaacatggaggcccagctcatccgccagatggagtccgaggggatcttcagcccctccgagctggagacccccaacctggccggccgggtgctcgactggctggagaagcacggggtcgagcgcctgaagcggatggcgatcagcggcgacgactgcgtggtgaagcccatcgacgaccgcttcgccgccgccctcaccgccctgaacgacatggggaaggtccggaaggacatcccgcagtgggagccctccaagggctggaacgactggcagcaggtccccttctgcagccaccacttccaccagctgatcatgaaggacggccgcgagatcgtggtcccctgccggaaccaggacgagctcgtggggcgcgcgcgggtgagccagggcgccgggtggtccctgcgcgagacggcctgcctgggcaagagctacgcccagatgtggcagctcatgtacttccaccggcgcgacctgcggctggcggccaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcggctccctgatcgggctcaccgcgcgggccacgtgggccaccaacatccaggtcgccatcaaccaggtgcgccgcctgatcggcaacgagaactacctggactacatgaccagcatgaagcggttcaagaacgagtccgacccggagggggccctctggtga

SEQ ID NO: 8623 - RNA, 9879 nt, synthetic construct
  misc_feature 1..9879: note = derived and/or modified CDS sequence (opt1) from DENV-1__GU131718__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcatcgagcacggcaccaccgcgaccatcacgccccaggcccccacgtccgagatccagctcaccgactacggggccctgaccctggactgcagcccccgcaccggcctcgacttcaacgagatggtgctgctgacgatgaaggagaagtcctggctcgtccacaagcagtggttcctggacctgccgctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgatcgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcaccagcatcgggaagctggtgcaccagatcttcggcacggcctacggggtcctcttctccggcgtgagctggaccatgaagatcgggatcggcgtgctgctgacctggctcggcctgaactcccgcagcacctccctgagcatgacgtgcatcgccgtcgggctcgtgaccctgtacctgggcgtgatggtccaggccgactccgggtgcgtgatcaactggaagggccgggagctcaagtgcgggagcggcatcttcgtgaccaacgaggtccacacctggacggagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagatgcgggacagctacacccaggtctgcgaccaccgcctgatgtccgcggccatcaaggacagcaaggccgtgcacgccgacatgggctactggatcgagtccgagaagaacgagacgtggaagctcgcccgggcgagcttcatcgaggtgaagacctgcatctggcccaagtcccacaccctgtggagcaacggcgtcctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtggtcgacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgacgggcaccctcgccgtgttcctgctgctcatcatggggcagctgacctggaacgacctgatccggctctgcatcatggtgggcgccaacgcgagcgaccgcatggggatgggcaccacgtacctggccctgatggccaccttcaagatgcgcccgatgttcgccgtcgggctcctgttccggcgcctgacctcccgggaggtgctcctgctgaccatcgggctcagcctggtggcctccgtcgagctgcccaacagcctcgaggagctgggcgacgggctggcgatgggcatcatgatcctcaagctgctgacggacttccagtcccaccagctctgggccaccctgctgagcctcaccttcatcaagaccacgctgtccctgcactacgcctggaagaccatggccatggtgctcagcatcgtctccctgatccccctgtgcctcagcaccacctcccagaagacgacctggctgcccgtgctgctcggcagcctggggtgcaagccgctgaccatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacacgctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacacgatgtggcacgtgacccggggcgccgtcctgatgtaccaggggaagcgcctggagcccagctgggcgtccgtgaagaaggacctcatcagctacggcggcgggtggcggctgcagggctcctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggaccagcggctcccccatcgtgaaccgcgaggggaagatcgtgggcctctacggcaacggggtcgtgaccacgagcggcacctacgtgagcgcgatcgcccaggccaaggcctcccaggaggggccgctgcccgagatcgaggacgaggtcttccggaagcgcaacctgaccatcatggacctccaccccggcagcgggaagacccggcgctacctgccggcgatcgtgcgggaggccatcaagcgcaagctgcggacgctcatcctggcccccacccgcgtggtcgcctccgagatggccgaggcgctgaagggcatgcccatccgctaccagaccaccgccgtcaagagcgagcacacgggcaaggagatcgtggacctcatgtgccacgccaccttcaccatgcggctgctgtcccccgtccgcgtgccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagacggtgtggttcgtcccctccatcaagagcggcaacgacatcgccaactgcctccggaagaacgggaagcgcgtgatccagctgtcccggaagaccttcgacaccgagtaccagaagaccaagaacaacgactgggactacgtggtcacgaccgacatcagcgagatgggcgccaacttccgcgcggaccgggtgatcgacccgcgccggtgcctgaagcccgtgatcctcaaggacgggcccgagcgcgtcatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacgcagcgcgcccagaacgccctggacaacctggtgatgctccacaacagcgagcagggcgggcgggcctaccgccacgcgatggaggagctgcccgacaccatcgagaccctgatgctcctggccctgatcgccgtgctcaccggcggggtcacgctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccacgaagaaggacctcgggatcggccacgtggcggtcgagaaccaccaccacgccaccatgctggacgtggacctgcaccccgcctccgcctggaccctctacgccgtggcgaccacgatcatcaccccgatgatgcgccacaccatcgagaacaccacggccaacatcagcctgaccgccatcgccaaccaggccgcgatcctgatggggctcgacaagggctggcccatctccaagatggacatcggcgtccccctgctggccctcgggtgctacagccaggtgaaccccctgaccctgaccgccgccgtgctcatgctggtcgcgcactacgccatcatcggcccggggctgcaggccaaggccacgcgggaggcccagaagcgcaccgcggccggcatcatgaagaaccccaccgtggacgggatcgtggccatcgacctcgaccccgtcgtgtacgacgccaagttcgagaagcagctgggccagatcatgctgctcatcctgtgcacctcccagatcctgctcatgcgcacgacctgggccctgtgcgagagcatcaccctggcgaccggccccctcacgaccctgtgggaggggtccccgggcaagttctggaacaccaccatcgccgtgagcatggccaacatcttccgggggtcctacctggccggcgccggcctcgcgttcagcctgatgaagtccctcgggggcgggcgccgggggacgggggcccagggcgagaccctcggcgagaagtggaagcgccagctgaaccagctgtccaagagcgagttcaacatctacaagcggtccgggatcatggaggtcgaccgcagcgaggccaaggagggcctcaagcgcggggagaccacccgccacgccgtgtcccggggcacggcgaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacctacgggtggaacctggtgaagctgcactccggcaaggacgtgttcttcacgccgcccgagaagtgcgacaccctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagacgctcgagcagatgcagcgcaagcacggcggcatgctggtgcggaacccgctgtcccgcaacagcacccacgagatgtactgggtgtcctgcgggaccggcaacatcgtcagcgccgtgaacatgacctcccggatgctcctgaaccgcttcaccatggcccaccgcaagcccacgtacgagaaggacgtggacctgggggcgggcacccggcacgtcgccgtggagcccgaggtggccaacctcgacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctgacgaagccctgggacgtgatccccatggtcacccagatcgcgatgaccgacaccacgcccttcggccagcagcgggtgttcaaggagaaggtggacacccgcaccccgaaggccaagcgggggaccgtccagatcatggaggtgacggcccgctggctctggggcttcctgtcccggaacaagaagccccgcatctgcacccgggaggagttcacccgcaaggtgcggagcaacgccgccatcggcgcggtcttcgtggacgagaaccagtggaactccgccaaggaggccgtggaggacgagcgcttctgggacctggtcaagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggcgggctgggacacccggatcaccgaggacgacctccagaacgaggccaagatcaccgacatcatggagccggagcacgccctgctggccacgtccatcttcaagctcacctaccagaacaaggtcgtgcgcgtgcagcggcccgccaagaacgggaccgtcatggacgtgatcagccgccgcgaccagcggggctccggccaggtgggcacctacggcctgaacacgttcaccaacatggaggcgcagctgatccgccagatggagagcgaggggatcttcctcccctccgagctggagacccccaacctggccgagcgggtcctcgactggctggagaagtacggcgtggagcgcctgaagcggatggccatcagcggggacgactgcgtggtcaagccgatcgacgaccgcttcgccaccgccctcacggcgctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcccgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccaccagccgcaccacgtggtccatccacgcgcaccaccagtggatgaccaccgaggacatgctcagcgtgtggaaccgggtgtggatcgaggagaacccctggatggaggacaagacccacgtctccagctggggcgacgtgccgtacctggggaagcgcgaggaccagtggtgcggctccctgatcggcctcacggcccgggccacctgggccagcaacatccaggtggccatcaaccaggtccgccgcctgatcgggaacgagaactacctggactacatgacctccatgaagcggttcaagaacgagggcgaccccgagggggcgctctggtga

SEQ ID NO: 8624 - RNA, 9879 nt, synthetic construct
  misc_feature 1..9879: note = derived and/or modified CDS sequence (opt1) from DENV-1__GU131720__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcacgctcatcgccatggacctgggcgagctgtgcgaggacaccatgacctacaagtgcccccggatcaccgaggccgagcccgacgacgtggactgctggtgcaacgccacggacacctgggtcacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcgcgaccaacatctggctgaagctgcgggacagctacacccaggtgtgcgaccaccgcctcatgtccgccgccatcaaggacagcaaggccgtccacgccgacatgggctactggatcgagtccgagaagaacgagacctggaagctggcgcgggccagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgcgaacgccagcgaccgcatggggatgggcacgacctacctggccctcatggccaccttcaagatgcgcccgatgttcgccgtgggcctgctgttccggcgcctcacctcccgggaggtcctgctgctcacgatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgaccttcatcaagacgaccctgtccctccactacgcctggaagaccatggcgatggtgctgagcatcgtgtccctgttccccctctgcctgagcaccacgtcccagaagaccacctggctgcccgtcctcctgggcagcttcgggtgcaagccgctgaccatgttcctcatcacggagaacaagatctggggccgcaagtcctggcccctgaacgaggggatcatggccgtgggcgtggtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgccgtgctgatgtaccaggggaagcgcctggagcccagctgggcgtccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgccctggacttcaagcccgggacgagcggctcccccatcgtcaaccgcgaggggaagatcgtgggcctctacggcaacggggtggtcaccaccagcggcacctacgtgagcgcgatcgcccaggccaaggcctcccaggaggggccgctgcccgagatcgaggacgaggtgttccggaagcgcaacctgacgatcatggacctccaccccggcagcgggaagacccggcgctacctgccggcgatcgtccgggaggccatcaagcgcaagctgcggaccctcatcctggcccccacccgcgtggtggcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgccaacttccgcgcggaccgggtcatcgacccgcgccggtgcctgaagcccgtgatcctcaaggacgggcccgagcgcgtcatcctggccggccccatgccggtgacggtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcacggtcgccgccaacgagatgggcctgctggagaccaccaagaaggacctcgggatcggccacgtggcggtggagaaccaccaccacgccaccatgctggacgtcgacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtcaaccccctgacgctgaccgccgccgtgctcatgctggtggcgcactacgccatcatcggcccggggctgcaggccaaggccacccgggaggcccagaagcgcaccgcggccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacatctacaagcggtccgggatcatggaggtggaccgcagcgaggccaaggagggcctcaagcgcggggagacgacccgccacgccgtctcccggggcaccgcgaagctgcgctggttcgtggagcggaacctggtgaagcccgaggggaaggtcatcgacctgggctgcggccgcgggggctggagctactactgcgccgggctcaagaaggtgaccgaggtgaagggctacacgaagggcgggcccggccacgaggagcccatcccgatggccacctacgggtggaacctggtcaagctgcactccggcaaggacgtgttcttcacgccgcccgagaagtgcgacaccctcctgtgcgacatcggggagagctcccccaacccgacgatcgaggagggccggaccctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggaccggcaacatcgtgagcgccgtcaacatgacgtcccggatgctcctgaaccgcttcaccatggcccaccgcaagcccacctacgagcgggacgtggacctgggggcgggcacccgccacgtggccgtcgagcccgaggtggccaacctcgacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctgctgaccaagccctgggacgtgatccccatggtgacccagatcgcgatgacggacaccacccccttcggccagcagcgcgtcttcaaggagaaggtggacacccggacgccgaaggccaagcgcgggaccgcccagatcatggaggtgaccgcccggtggctctggggcttcctgtcccgcaacaagaagccccggatctgcacccgcgaggagttcacgcggaaggtccgcagcaacgccgcgatcggcgccgtgttcgtggacgagaaccagtggaactccgccaaggaggccgtcgaggacgagcggttctgggacctggtgcagaaggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgagaacagcctgtccggggtcgagggcgaggggctccacaagctgggctacatcctgcgggacatcagcaagatccccgggggcaacatgtacgcggacgacaccgccggctgggacacccgcatcacggaggacgacctccagaacgaggccaagatcaccgacatcatgaagccggagcacgccctgctggccacctccatcttcaagctcacctaccagaacaaggtggtgcgggtccagcgccccgcgaagaacgggacggtgatggacgtgatcagccgccgggaccagcgcggctccgggcaggtcggcacctacggcctgaacaccttcaccaacatggaggcccagctgatccggcagatggagagcgaggggatcttcctcccctccgagctggagacgcccaacctggccgagcgcgtgctcgactggctggagaagtacggcgtggagcggctgaagcgcatggccatcagcggggacgactgcgtcgtgaagccgatcgacgaccggttcgccaccgcgctcaccgccctgaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctcgtcggccgggcccgcgtgtcccagggggccggctggagcctgcgggagaccgcctgcctgggcaagagctacgcgcagatgtggcagctcatgtacttccaccgccgggacctgcgcctggccgccaacgccatctgctccgcggtgcccatcgactgggtccccacgagccggaccacctggtccatccacgcccaccaccagtggatgaccacggaggacatgctcagcgtgtggaaccgcgtgtggatcgaggagaacccctggatggaggacaagacccacgtctccagctggggcgacgtgccgtacctggggaagcgggaggaccagtggtgcggctccctgatcggcctcaccgcccgcgccacctgggccagcaacatccaggtggcgatcaaccaggtccgccggctgatcgggaacgagaactacctggactacatgacctccatgaagcgcttcaagaacgagggcgaccccgagggggccctctggtga

SEQ ID NO: 8625 - RNA, 9879 nt, synthetic construct
  misc_feature 1..9879: note = derived and/or modified CDS sequence (opt1) from DENV-1__HM181960__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggccgggtgatcgacctgggctgcgggcgcggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacccacgagatgtactgggtgtcctgcggcaccgggaacatcgtcagcgccgtgaacatgacgtcccgcatgctgctcaaccggttcaccatggcgcaccgcaagcccacctacgagcgggacgtggacctgggcgccggcacccgccacgtcgccgtggagcccgaggtggccaacctggacatcatcgggcagcggatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgcgtgttcaaggagaaggtggacacccggacgccgaaggccaagcgcggcaccgcccagatcatggaggtcaccgccaagtggctgtggggcttcctctcccggaacaagaagccccgcatctgcacccgggaggagttcacgcgcaaggtgcggagcaacgcggccatcggggccgtgttcgtcgacgagaaccagtggaactccgccaaggaggcggtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtggagggggagggcctgcacaagctcgggtacatcctgcgggacatcagcaagatccccggcggcaacatgtacgccgacgacaccgccgggtgggacacccgcatcacggaggacgacctgcagaacgaggcccgcatcaccgacatcatggagccggagcacgccctcctggcgaagtccatcttcaagctgacctaccagaacaaggtggtccgggtgcagcgccccgccaagaacggcaccgtgatggacgtcatcagccggcgcgaccagcgggggtccggccaggtgggcacgtacgggctcaacaccttcaccaacatggaggcccagctgatccgccagatggagagcgagggcatcttctcccccagcgagctggagacccccaacctcgccgagcgggtgctggactggctggagaagtacggggtcgagcgcctcaagcggatggccatctccggcgacgactgcgtggtgaagccgatcgacgaccgcttcgcgacggccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcgtgcctcggcaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgggaggaccagtggtgcggcagcctcatcgggctgaccgcccgcgccacctgggcgaccaacatccaggtggccatcaaccaggtccggcgcctgatcggcaacgagaactacctcgactacatgacctccatgaagcggttcaagaacgagagcgaccccgagggggccctgtggtga

SEQ ID NO: 8626 - RNA, 9879 nt, synthetic construct
  misc_feature 1..9879: note = derived and/or modified CDS sequence (opt1) from DENV-1__HM181963__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggggagttctgcgaggacaccatgacctacaagtgcccccgcatcaccgaggccgagcccgacgacgtggactgctggtgcaacgccaccgacacctgggtgacctacgggacctgcagccagatcggggagcaccggcgcgacaagcggtccgtggccctggcgccccacgtgggcctcgggctggagacccgcacggagacctggatgagctccgagggcgcctggaagcagatccagcgggtggagacctgggccctgcgccaccccgggttcaccgtgatcgccctcttcctggcgcacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggccaaggacaagcccaccctggacatcgagctgctcaagaccgaggtcacgaaccccgcggtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgcgaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggccgagccgcccttcggggagagctacatcgtgatcggcgtgggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtcttcacctccgtggggaagctggtgcaccagatcttcggcacggcctacggggtcctgttcagcggcgtgtcctggaccatgaagatcgggatcggcgtgctcctgacctggctgggcctcaacagccgctccaccagcctgtccatgacgtgcatcgccgtcgggctggtgaccctctacctgggcgtgatggtccaggccgacagcgggtgcgtgatcaactggaagggccgggagctgaagtgcgggagcggcatcttcgtgaccaacgaggtccacacctggacggagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagctgaccgtggtcgtgggggacgtggccggcatcctcgcgcaggggaagaagatgatccggccccagcccatggagtacaagtactcctggaagtcctggggcaaggccaagatcatcggcgccgacgtccagaacaccaccttcatcatcgacgggcccaacacgccggagtgccccgacgaccagcgcgcctggaacatctgggaggtggaggactacggcttcgggatcttcaccaccaacatctggctgaagctgcgggactcctacacccaggtgtgcgaccaccgcctcatgagcgcggccatcaaggactccaaggccgtccacgccgacatgggctactggatcgagagcgagaagaacgagacgtggaagctggcccgggcgtccttcatcgaggtgaagacctgcatctggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgacgggcaccctggccgtcttcttcctgctcatcatggggcagctgacctggaacgacctgatccggctctgcatcatggtgggcgccaacgcgtccgaccgcatggggatgggcaccacgtacctggccctgatggccaccttcaagatgcgcccgatgttcgccgtgggcctcctgttccggcgcctgaccagccgggaggtcctcctgctgaccatcgggctctccctggtggccagcgtcgagctgcccaactccctcgaggagctgggcgacgggctggcgatgggcatcatgatcctcaagctgctgacggacttccagagccaccagctctgggccaccctgctgtccatgaccttcatccgcaccacgttcagcctccactacgcctggaagaccatggccatggtgctgtccatcgtgagcctgttccccctctgcctgtccaccaccagccagaagacgacctggctgcccgtcctcctgggctccctggggtgcaagccgctcaccatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgtggtctcctgggaggaggaggccgagcacagcggcgcctcccacaacatcctcgtggaggtgcaggacgacgggaccatgaagatcaaggacgaggagcgcgacgacacgctgaccatcctgctcaaggcgaccctgctggccgtcagcggcgtgtacccgctctccatccccgccaccctgttcgtgtggtacttctggcagaagaagaagcagcggagcggggtcctgtgggacacccccagcccgcccgaggtggagcgcgccgtgctcgacgacggcatctaccggatcatgcagcgcggcctgctggggcggagccaggtcggcgtgggggtgttccaggagaacgtcttccacacgatgtggcacgtgacccgcggcgccgtgctgatgtaccaggggaagcggctcgagccctcctgggcgagcgtcaagaaggacctgatctcctacggcggcgggtggcgcctgcagggcagctggaacaccggggaggaggtccaggtgatcgccgtcgagcccggcaagaaccccaagaacgtgcagaccgcccccgggacgttcaagacctccgagggcgaggtgggcgccatcgccctcgacttcaagcccgggaccagcggcagccccatcgtcaaccgggaggggaaggtggtgggcctgtacggcaacggggtcgtgaccacgtccggcacctacgtgagcgcgatcgcccaggccaaggcctcccaggaggggcccctgccggagatcgaggacgaggtcttccgcaagcggaacctcaccatcatggacctgcaccccggcagcgggaagacccgccggtacctgcccgcgatcgtgcgcgaggccatcaagcggaagctccgcacgctgatcctggccccgacccgcgtggtcgcctccgagatggccgaggcgctcaagggcatgcccatccggtaccagaccaccgccgtcaagagcgagcacacgggcaaggagatcgtggacctgatgtgccacgccaccttcaccatgcgcctgctctcccccgtccgggtgcccaactacaacatgatcatcatggacgaggcccacttcaccgacccgagctccatcgccgcgcgcgggtacatcagcacgcgggtgggcatgggggaggccgccgccatcttcatgaccgccacgccgcccggctccgtcgaggcgttcccccagagcaacgccgtgatccaggacgaggagcgcgacatcccggagcggtcctggaacagcgggtacgagtggatcaccgacttccccggcaagacggtgtggttcgtcccctccatcaagagcggcaacgacatcgccaactgcctgcgcaagaacgggaagcgggtgatccagctgtcccgcaagaccttcgacaccgagtaccagaagaccaagaacaacgactgggactacgtggtcacgaccgacatcagcgagatgggcgccaacttccgggcggaccgcgtgatcgacccccggcgctgcctcaagccggtcatcctgaaggacgggcccgagcgggtgatcctggccggccccatgcccgtgaccgtcgcctccgccgcccagcgccgggggcgcatcggccggaaccacaacaaggagggcgaccagtacatctacatggggcagccgctcaacaacgacgaggaccacgcgcactggaccgaggccaagatgctgctggacaacatcaacacgcccgagggcatcatccccgccctcttcgagcccgagcgcgagaagtccgccgccatcgacggggagtaccgcctgcggggcgaggcgcgcaagaccttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgccgcgggccggcgcagcgtctccggggacctgatcctggagatcggcaagctcccccagcacctgacgcagcgggcccagaacgccctggacaacctcgtgatgctgcacaacagcgagcagggcgggcgcgcctaccggcacgcgatggaggagctgccggacaccatcgagaccctcatgctgctggccctcatcgccgtgctgaccggcggggtcacgctgttcttcctctccggccgcgggctgggcaagaccagcatcggcctgctctgcgtgatggcctccagcgtgctgctgtggatggcctccgtcgagccccactggatcgcggccagcatcatcctcgagttcttcctgatggtgctgctcatccccgagcccgaccggcagcgcaccccgcaggacaaccagctggcctacgtggtcatcgggctcctgttcatgatcctgaccgtggccgccaacgagatgggcctgctcgagaccacgaagaaggacctggggatcggccacgtggcggtcgagaaccaccaccacgccgccatgctggacgtggacctccaccccgcctccgcctggaccctgtacgcggtggccaccaccatcatcacgcccatgatgcggcacaccatcgagaacaccaccgccaacatcagcctgacggccatcgccaaccaggcggccatcctcatggggctggacaagggctggccgatctccaagatggacatcggcgtccccctgctcgccctggggtgctacagccaggtgaaccccctgaccctcaccgccgcggtgctgatgctggtcgcccactacgccatcatcggccccgggctccaggccaaggccacccgcgaggcgcagaagcgcacggccgccggcatcatgaagaacccgaccgtggacgggatcgtggccatcgacctggaccccgtcgtgtacgacgccaagttcgagaagcagctgggccagatcatgctcctgatcctgtgcacctcccagatcctcctgatgcggaccacgtgggcgctgtgcgagagcatcaccctcgccaccggccccctgaccacgctgtgggaggggtcccccggcaagttctggaacaccaccatcgccgtgagcatggccaacatcttccgcgggagctacctcgccggcgcgggcctggccttctccctgatgaagtccctcgggggcgggcggcgcggcaccggggcccagggcgagacgctgggcgagaagtggaagcggcagctgaaccagctctccaagagcgagttcaacacctacaagcgctccgggatcatggaggtcgaccggagcgaggccaaggagggcctgaagcgcggggagaccaccaagcacgcggtgtcccggggcacggccaagctgcgctggttcgtggagcggaacctcgtcaagccggaggggaaggtgatcgacctgggctgcggccgcgggggctggagctactactgcgccgggctgaagaaggtgaccgaggtcaagggctacaccaagggcgggcccggccacgaggagcccatccccatggccacctacgggtggaacctggtgaagctccactccggcaaggacgtgttcttcatcccgcccgagaagtgcgacacgctgctgtgcgacatcggggagagctcccccaaccccaccatcgaggagggccggaccctccgcgtcctgaagatggtggagccgtggctgcgggggaaccagttctgcatcaagatcctcaacccctacatgcccagcgtggtcgagaccctggagcagatgcagcgcaagcacggcggcatgctggtgcggaaccccctctcccgcaacagcacgcacgagatgtactgggtgtcctgcgggaccggcaacatcgtcagcgccgtgaacatgacctcccggatgctgctgaaccgcttcaccatggcgcaccgcaagccgacctacgagcgggacgtggacctcggggccggcacgcgccacgtcgccgtggagcccgaggtcgccaacctggacatcatcggccagcggatcgagaacatcaagcacgagcacaagagcacctggcactacgacgaggacaacccctacaagacctgggcctaccacgggtcctacgaggtgaagcccagcggcagcgcgtccagcatggtgaacggggtcgtgaagctgctcaccaagccgtgggacgtgatccccatggtcacgcagatcgccatgaccgacaccacccccttcggccagcagcgcgtgttcaaggagaaggtggacacgcggacccccaaggccaagcgcgggaccgcccagatcatggaggtcaccgccaagtggctgtggggcttcctgtcccggaacaagaagccgcgcatctgcacgcgggaggagttcacccgcaaggtgcggagcaacgcggccatcggcgccgtgttcgtcgacgagaaccagtggaactccgccaaggaggcggtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacgcgcatcaccgaggacgacctgcagaacgaggccaagatcaccgacatcatggagcccgagcacgccctgctcgcgaagtccatcttcaagctgacctaccagaacaaggtggtccgggtgcagcgcccggccaagaacgggacggtgatggacgtcatcagccgccgggaccagcgcggctccggccaggtgggcacctacggcctgaacaccttcaccaacatggaggcccagctcatccggcagatggagagcgaggggatcttctcccccagcgagctggagacgcccaacctggccggccgcgccctcgactggctggagaagcacggggtggagcggctgaagcgcatggcgatctccggcgacgactgcgtcgtgaagcccatcgacgaccggttcgccaccgccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcccgcgtgtcccagggcgcggggtggagcctgcgggagaccgcctgcctgggcaagtcctacgcccagatgtggcagctcatgtacttccaccgccgggacctgcgcctggccgcgaacgccatctgcagcgccgtgccggtcgactgggtgcccacgtcccggaccacctggagcatccacgcccaccaccagtggatgaccacggaggacatgctctccgtgtggaaccgcgtctggatcgaggagaacccctggatggaggacaagacccacatcagctcctggggcgacgtgccctacctgggcaagcgggaggaccagtggtgcggcagcctgatcgggctcaccgcccgcgcgacctgggccacgaacatccaggtggccatcaaccaggtccgccggctgctgggcaacgagaactacctcgactacatgacctccatgaagcgcttcaagaacgagagcgacccggagggggccctgtggtga

SEQ ID NO: 8627 - RNA, 9879 nt, synthetic construct
  misc_feature 1..9879: note = derived and/or modified CDS sequence (opt1) from DENV-1__HM181964__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactgcgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgctgagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctcaaggacgggcccgagcgggtcatcctggccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccggggcgaggcgcgcaagacgttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacctactccgaccccctggccctgcgcgagttcaaggagttcgccgcgggccggcgcagcgtctccggggacctcatcctggagatcggcaagctgccgcagcacctcacccagcgggcccagaacgccctggacaacctggtgatgctccacaacagcgagcagggcgggcgcgcctaccggcacgcgatggaggagctgcccgacacgatcgagaccctgatgctcctggccctgatcgccgtgctcaccggcggggtcaccctgttcttcctgtccggccgcgggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggacaagcagcggacgccccaggacaaccagctcgcctacgtggtcatcgggctgctgttcatgatcctcaccgtggccgccaacgagatgggcctgctggagaccaccaagaaggacctcgggatcggccacgtggcggtcgagaaccaccaccacgccgccatgctggacgtggacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtccccctgctggccctcgggtgctacagccaggtgaaccccctgacgctgaccgccgcggtgctcatgctggtcgcccactacgccatcatcggcccggggctgcaggccaaggccacccgcgaggcgcagaagcggaccgccgccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtcgaccgcagcgaggccaaggagggcctcaagcgcggggagaccaccaagcacgcggtgtcccgcggcaccgccaagctgcggtggttcgtggagcgcaacctggtcaagcccgaggggaaggtgatcgacctgggctgcggccgcggcgggtggagctactactgcgccgggctcaagaaggtgacggaggtcaaggggtacaccaagggcggccccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtccgcgtgcagcggcccgccaagaacgggaccgtgatggacgtcatcagccgccgggaccagcgcggctccggccaggtgggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggccatctccggggacgactgcgtggtgaagccgatcgacgaccggttcgcgacggccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8628 - RNA, 9879 nt, synthetic construct
  misc_feature 1..9879: note = derived and/or modified CDS sequence (opt1) from DENV-1__HM181966__SS-prME
  source 1..9879: mol_type = other RNA
agcgtgaccatgctgctcatgctgatgcccaccgccctggccttccacctcaccacccggggcggggagccccacatgatcgtgaccaagcaggagcgggggaagtccctgctgttcaagaccagcgtgggggtgaacatgtgcacgctcatcgccatggacctgggcgagctgtgcgaggacaccatgacctacaagtgcccccggatcaccgaggccgagcccgacgacgtggactgctggtgcaacgccacggacacctgggtgacctacgggacctgctcccagacgggcgagcaccggcgcgacaagcggagcgtggccctcgcgccccacgtcggcctggggctggagacccgcaccgagacctggatgtccagcgagggcgcgtggaagcagatccagcgggtggagacgtgggccctccgccaccccgggttcaccgtgatcgccctgttcctggcccacgcgatcggcacctccatcacccagaaggggatcatcttcatcctcctgatgctggtcacgcccagcatggccatgcggtgcgtgggcatcggctcccgcgacttcgtggaggggctcagcggcgccacctgggtcgacgtggtgctggagcacgggtcctgcgtcaccaccatggccaaggacaagcccacgctggacatcgagctcctgaagaccgaggtgaccaaccccgccgtgctgcggaagctctgcatcgaggcgaagatcagcaacaccacgaccgactcccgctgcccgacccagggcgaggccaccctgatggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcaccctggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctcaagctgagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggtgggcatcctggcccaggggaagaagatgatccggccccagcccatggagcacaagtacagctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtgtgcgaccaccgcctgatgtccgccgcgatcaaggacagcaaggccgtccacgccgacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttcaagggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcaccctggccgtcttcctcctgctgatcatggggcagctcacgtggaacgacctgatccggctgtgcatcatggtgggcgccaacgccagcgaccgcatggggatgggcaccacctacctcgcgctgatcgccaccttcaagatgcgcccgatgttcgccgtgggcctcctgttccggcgcctgacgtcccgggaggtcctgctcctgaccatcgggctgagcctcgtggcctccgtcgagctgcccaacagcctggaggagctcggcgacgggctggccatgggcatcatgatcctgaagctcctgaccgacttccagtcccaccagctgtgggcgaccctcctgagcttcacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcgccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccaaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagaccagcgagggcgaggtgggcgccatcgccctcgacttcaagcccgggacgtccggcagccccatcgtcaaccgcgaggggaagatcgtgggcctgtacggcaacggggtggtcaccaccagcggcacctacgtgtccgccatcgcgcaggccaaggccagccaggaggggcccctgccggagatcgaggacgaggtgttccggaagcgcaacctcacgatcatggacctgcaccccggctccgggaagacccggcgctacctgcccgccatcgtccgggaggcgatcaagcgcaagctccggaccctgatcctggccccgacccgcgtggtggccagcgagatggccgaggccctcaagggcatgcccatccgctaccagacgaccgcggtcaagtccgagcacaccggcaaggagatcgtggacctgatgtgccacgccaccttcacgatgcggctgctcagccccgtgcgcgtccccaactacaacatgatcatcatggacgaggcccacttcaccgacccgtccagcatcgccgcccgggggtacatctccacccgcgtgggcatgggggaggcggccgccatcttcatgaccgccacgccgcccggcagcgtggaggccttcccccagtccaacgcggtcatccaggacgaggagcgggacatcccggagcgcagctggaactccgggtacgagtggatcaccgacttccccggcaagaccgtgtggttcgtgcccagcatcaagtccggcaacgacatcgccaactgcctgcggaagaacgggaagcgcgtcatccagctgagccggaagaccttcgacacggagtaccagaagaccaagaacaacgactgggactacgtggtgaccaccgacatctccgagatgggcgccaacttccgcgccgaccgggtcatcgacccccgccggtgcctcaagccggtgatcctgaaggacgggcccgagcgcgtcatcctggcgggccccatgcccgtgacggtggccagcgccgcccagcggcgcgggcggatcggccgcaaccacaacaaggagggcgaccagtacatctacatggggcagccgctcaacaacgacgaggaccacgcccactggaccgaggcgaagatgctgctggacaacatcaacacccccgagggcatcatccccgccctcttcgagcccgagcgggagaagtccgccgccatcgacggggagtaccgcctgcgcggcgaggcccggaagaccttcgtcgagctgatgcgccgcggggacctcccggtgtggctgagctacaaggtggcgagcgagggcttccagtactccgaccgccggtggtgcttcgacggcgagcgcaacaaccaggtcctggaggagaacatggacgtggagatctggacgaaggagggggagcggaagaagctccgcccccggtggctggacgcccgcacctacagcgaccccctggccctccgggagttcaaggagttcgccgccggccgccggtccgtgagcggggacctgatcctggagatcggcaagctcccccagcacctgacccagcgcgcgcagaacgccctggacaacctcgtcatgctgcacaactccgagcagggcgggcgggcctaccgccacgccatggaggagctgccggacaccatcgagacgctcatgctgctggcgctcatcgccgtgctgaccggcggggtgaccctgttcttcctcagcggccgggggctgggcaagacctccatcggcctgctctgcgtcatggccagctccgccctgctgtggatggccagcgtggagccccactggatcgcggcctccatcatcctcgagttcttcctgatggtgctgctcatccccgagcccgaccgccagcggaccccgcaggacaaccagctggcctacgtcgtgatcgggctcctgttcatgatcctgacggtggccgccaacgagatgggcctgctcgagaccaccaagaaggacctggggatcggccacgtcgcggtggagaaccaccaccacgccaccatgctggacgtggacctccaccccgccagcgcctggacgctgtacgccgtcgcgaccaccatcatcacccccatgatgcgccacacgatcgagaacaccaccgccaacatctccctgaccgccatcgccaaccaggccgcgatcctcatggggctggacaagggctggccgatcagcaagatggacatcggcgtgcccctgctcgccctggggtgctactcccaggtgaaccccctgacgctcaccgccgccgtcctgatgctggtggcgcactacgccatcatcggccccgggctccaggccaaggccacccgggaggcccagaagcgcaccgcggccggcatcatgaagaacccgacggtggacgggatcgtcgccatcgacctggaccccgtggtgtacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagccccggcaagttctggaacacgaccatcgccgtctccatggccaacatcttccgggggagctacctcgccggcgccggcctggcgttcagcctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtgagccggggcaccgcgaagctgcgctggttcgtcgagcggaacctggtgaagccggaggggaaggtgatcgacctcggctgcggccgcgggggctggtcctactactgcgccgggctgaagaaggtcaccgaggtgaagggctacacgaagggcgggcccggccacgaggagcccatccccatggccacctacgggtggaacctggtgaagctccacagcggcaaggacgtcttcttcaccccgcccgagaagtgcgacaccctgctgtgcgacatcggggagtccagccccaaccccacgatcgaggagggccggaccctccgcgtgctgaagatggtggagccgtggctgcgggggaaccagttctgcatcaagatcctcaacccctacatgccctccgtcgtggagaccctggagcagatgcagcgcaagcacggcggcatgctggtgcggaaccccctcagccgcaactccacccacgagatgtactgggtcagctgcgggaccggcaacatcgtgtccgccgtgaacatgacgagccggatgctgctgaaccgcttcaccatggcccaccgcaagccgacctacgagcgggacgtcgacctcggggcgggcacccgccacgtggccgtggagcccgaggtcgccaacctggacatcatcggccagcggatcgagaacatcaagcacgagcacaagtccacgtggcactacgacgaggacaacccctacaagacctgggcctaccacgggagctacgaggtgaagccctccggcagcgccagctccatggtcaacggggtggtgaagctgctcaccaagccgtgggacgtcatccccatggtgacccagatcgcgatgacggacaccacccccttcggccagcagcgcgtgttcaaggagaaggtcgacacccggacgcccaaggccaagcgcgggaccgcccagatcatggaggtgaccgcccggtggctgtggggcttcctgagccgcaacaagaagccgcggatctgcacccgcgaggagttcacgcggaaggtgcgctccaacgccgcgatcggcgccgtcttcgtggacgagaaccagtggaacagcgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgcggacgacaccgccggctgggacacccgcatcacggaggacgacctgcagaacgaggccaagatcaccgacatcatggagcccgagcacgccctgctcgccaccagcatcttcaagctgacctaccagaacaaggtcgtgcgggtgcagcgcccggcgaagaacgggacggtcatggacgtgatctcccgccgggaccagcgcggcagcggccaggtgggcacctacggcctgaacaccttcaccaacatggaggcccagctcatccggcagatggagtccgaggggatcttcctgcccagcgagctggagacgcccaacctcgccgagcgcgtcctggactggctggagaagtacggcgtggagcggctcaagcgcatggccatctccggggacgactgcgtggtcaagcccatcgacgaccggttcgccaccgcgctgaccgccctgaacgacatgggcaaggtgcgcaaggacatcccgcagtgggagcccagcaaggggtggaacgactggcagcaggtccccttctgctcccaccacttccaccagctcgtcatgaaggacggccgggagatcgtggtgccctgccgcaaccaggacgagctggtcggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtgccggtcgactgggtgcccacgtcccggaccacctggagcatccacgcccaccaccagtggatgaccacggaggacatgctgtccgtgtggaaccgcgtctggatcgaggagaacccctggatggaggacaagacccacgtgagctcctggggcgacgtgccctacctggggaagcgggaggaccagtggtgcggcagcctcatcggcctgaccgcccgcgccacctgggcctccaacatccaggtcgcgatcaaccaggtgcgccggctgatcgggaacgagaactacctcgactacatgaccagcatgaagcgcttcaagaacgagggcgacccggagggggccctgtggtga

SEQ ID NO: 8629 - RNA, 9879 nt, synthetic construct
  misc_feature 1..9879: note = derived and/or modified CDS sequence (opt1) from DENV-1__GU131721__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgccgggaagctcgtgcaccagatcttcggcaccgcctacggggtcctgttcagcggcgtgtcctggacgatgaagatcgggatcggcgtgctgctcacctggctgggcctgaacagccgctccaccagcctctccatgacctgcatcgccgtcgggctggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgtggcgggcatcctggcccaggggaagaagatgatccggccccagcccatggagtacaagtactcctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggactcctacacccaggtgtgcgaccaccgcctgatgagcgccgccatcaaggactccaaggccgtccacgccgacatgggctactggatcgagagcgagaagaacgagacctggaagctggcgcgggcctccttcatcgaggtgaagacgtgcatctggcccaagagccacaccctctggtccaacggcgtgctggagagcgagatgatcgtccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgcgaacgcctccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggcgagcgtcgagctccccaactccctggaggagctgggcgacgggctcgccatgggcatcatgatcctgaagctgctcaccgacttccagagccaccagctgtgggccacgctgctctccctgaccttcatcaagaccaccttcagcctgcactacgcctggaagacgatggcgatggtgctctccatcgtcagcctgttccccctgtgcctctccaccaccagccagaagaccacgtggctgcccgtgctgctcggctccctggggtgcaagccgctgaccatgttcctcatcgccgagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagaaggccgccgaggtctcctgggaggaggaggccgagcacagcggcgcgtcccacaacatcctggtggaggtgcaggacgacgggaccatgaagatcaaggacgaggagcgggacgacaccctcaccatcctgctgaaggccacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgcggtgctgatgtaccaggggaagcgcctggagccctcctgggccagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggacctccggcagccccatcgtcaaccgcgaggggaagatcgtgggcctctacggcaacggggtggtcaccacctccggcacgtacgtgagcgccatcgcccaggccaaggcgagccaggaggggccgctgcccgagatcgaggacgaggtgttccggaagcgcaacctgaccatcatggacctccaccccggctccgggaagacccggcgctacctgccggccatcgtccgggaggccatcaagcgcaagctgcgcaccctcatcctggcccccacgcgggtggtggccagcgagatggcggaggccctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgcggcccgggggtacatctccacccgcgtgggcatgggggaggccgccgccatcttcatgacggcgacgccgcccggcagcgtggaggccttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgcgaacttccgcgccgaccgggtcatcgacccgcgccggtgcctgaagcccgtgatcctcaaggacgggcccgagcgcgtgatcctggccggccccatgccggtcaccgtggccagcgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgcggccggccgccggtccgtgagcggggacctcatcctggagatcggcaagctgccgcagcacctcacccagcgcgcccagaacgccctggacaacctggtcatgctccacaactccgagcagggcgggcgggcgtaccgccacgccatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcgggctgctgttcatgatcctcaccgtcgccgcgaacgagatgggcctgctggagaccaccaagaaggacctcgggatcggccacgtggccgtggagaaccaccaccacgccgccatgctggacgtcgacctgcgccccgccagcgcgtggacgctctacgccgtggccaccaccatcatcaccccgatgatgcgccacacgatcgagaacaccaccgccaacatctccctgaccgccatcgcgaaccaggccgccatcctgatggggctcgacaagggctggcccatcagcaagatggacatcggcgtgcccctgctggccctcgggtgctactcccaggtcaaccccctgacgctgaccgcggccgtgctcatgctggtggcccactacgccatcatcggcccggggctgcaggccaaggcgacccgggaggcccagaagcgcaccgccgccggcatcatgaagaaccccacggtcgacgggatcgtggccatcgacctcgaccccgtggtctacgacgcgaagttcgagaagcagctgggccagatcatgctgctcatcctgtgcaccagccagatcctgctcatgcggaccacctgggccctgtgcgagtccatcacgctggccaccggccccctcaccaccctgtgggaggggagcccgggcaagttctggaacacgaccatcgccgtgtccatggccaacatcttccgcgggagctacctggcgggcgccggcctcgccttctccctgatgaagtccctcgggggcgggcggcgcgggaccggggcccagggcgagaccctcggcgagaagtggaagcggcagctgaaccagctgagcaagtccgagttcaacacgtacaagcgcagcgggatcatggaggtggaccggtccgaggcgaaggagggcctcaagcgcggggagaccaccaagcacgccgtcagccggggcaccgccaagctgcgctggttcgtggagcggaacctggtgaagcccgaggggaaggtcatcgacctgggctgcggccgcgggggctggtcctactactgcgccgggctcaagaaggtgacggaggtgaagggctacaccaagggcgggcccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccggaccctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgcggtcaacatgacgagccgcatgctcctgaaccggttcaccatggcccaccgcaagcccacctacgagcgggacgtggacctgggggccggcacccgccacgtggccgtcgagcccgaggtggccaacctcgacatcatcggccagcggatcgagaacatcaagcacgagcacaagtccacgtggcactacgacgaggacaacccctacaagacctgggcgtaccacgggagctacgaggtgaagccgtccggcagcgcctccagcatggtcaacggggtggtcaagctgctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgaagtggctctggggcttcctgagccggaacaagaagccccgcatctgcacccgggaggagttcacgcgcaaggtccggtccaacgccgccatcggcgccgtgttcgtggacgagaaccagtggaacagcgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcgcggttcctcgagttcgaggccctgggcttcatgaacgaggaccactggttcagccgcgagaactccctgagcggggtcgagggcgaggggctccacaagctgggctacatcctgcgggacatctccaagatccccgggggcaacatgtacgccgacgacaccgccggctgggacacccgcatcacggaggacgacctccagaacgaggcccgcatcaccgacatcatggagccggagcacgcgctgctggccaagagcatcttcaagctcacctaccagaacaaggtggtgcgggtccagcgccccgccaagaacgggaccgtgatggacgtgatctcccggcgcgaccagcggggcagcgggcaggtcggcacgtacggcctgaacaccttcaccaacatggaggcccagctgatccgccagatggagtccgaggggatcttcagcccctccgagctcgagacccccaacctggccgagcgggtgctggactggctcgagaagtacggcgtggagcgcctgaagcggatggcgatcagcggggacgactgcgtcgtgaagccgatcgacgaccgcttcgccacggccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctggtcggccgcgcccgggtgtcccagggggcgggctggagcctccgcgagaccgcctgcctgggcaagagctacgcccagatgtggcagctgatgtacttccaccggcgcgacctccggctggccgcgaacgccatctgctccgccgtgcccgtcgactggatccccaccagccgcacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgggaggaccagtggtgcggctccctgatcggcctgaccgcccgcgcgacctgggccaccaacatccaggtggccatcaaccaggtgcggcgcctcatcgggaacgagaactacctggactacatgaccagcatgaagcggttcaagaacgagggcgagcccgagggggccctgtggtga

SEQ ID NO: 8630 - RNA, 9879 nt, synthetic construct
  misc_feature 1..9879: note = derived and/or modified CDS sequence (opt1) from DENV-1__GU131723__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcgtggggcagctgacctggaacgacctcatccgcctgtgcatcatggtcggcgccaacgcgagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtcctcagcgtggtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcgggtgggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtggagcggctgaagcgcatggccatctccggggacgactgcgtcgtgaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8631 - RNA, 9879 nt, synthetic construct
  misc_feature 1..9879: note = derived and/or modified CDS sequence (opt1) from DENV-1__GU131725__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgggacaagcggagcgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttctccgagatggtcctgctgaccatgaaggagaagtcctggctcgtgcacaagcagtggttcctggacctgcccctcccctggaccagcggggcctccaccagccaggagacgtggaaccggcaggacctgctggtgaccttcaagaccgcccacgcgaagaagcaggaggtcgtggtgctcggctcccaggagggcgccatgcacaccgccctgacgggggccaccgagatccagaccagcggcaccacgaccatcttcgccgggcacctgaagtgccgcctcaagatggacaagctgaccctgaagggcatgtcctacgtcatgtgcaccgggagcttcaagctcgagaaggaggtggcggagacgcagcacggcaccgtgctggtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctgctgacgtggctcggcctgaacagccgctccaccagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgacgaacgaggtgcacacctggaccgagcagtacaagttccaggcggactccccgaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagctcaccgtggtggtcggggacgtggcgggcatcctggggcagggcaagaagatgatccggccccagcccatggagtacaagtactcctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggactcctacacccaggtctgcgaccaccgcctgatgagcgccgccatcaaggactccaaggccgtgcacgccgacatgggctactggatcgagagcgagaagaacgagacctggaagctggcgcgggcctccttcatcgaggtgaagacctgcatctggcccaagagccacacgctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcaccacggtggtggtcgacgagcactgcgggaaccggggcccgagcctccgcaccaccaccgtgacggggaagatcatccacgagtggtgctgccggtcctgcaccctgccgcccctgcgcttccggggcgaggacgggtgctggtacggcatggagatccgccccgtgaaggagaaggaggagaacctcgtcaagagcatggtgagcgccggctccggggaggtggacagcttctccctgggcctgctctgcatcagcatcatgatcgaggaggtcatgcggtcccgctggagccggaagatgctgatgaccgggaccctggccgtgttcttcctcctgatcatgggccagctgacgtggaacgacctcatccgcctgtgcatcatggtgggggcgaacgcctccgaccgcatgggcatgggcaccacctacctggccctcatggccaccttcaagatgcggccgatgttcgccgtcgggctgctgttccgccggctcacgagccgcgaggtgctgctgctcaccatcggcctgtccctggtggcgagcgtcgagctccccaactccctggaggagctgggggacggcctcgccatgggcatcatgatcctgaagctgctcaccgacttccagagctaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgcccgtgctgctcgggtccctgggctgcaagccgctgacgatgttcctcatcgccgagaacaagatctgggggcgcaagagctggcccctgaacgagggcatcatggccgtggggatcgtcagcatcctgctctccagcctgctgaagaacgacgtgcccctcgccggccccctgatcgccggcgggatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgcgacgacaccctcaccatcctgctgaaggccaccctcctggccgtcagcggggtgtacccgctgtccatccccgccaccctcttcgtgtggtacttctggcagaagaagaagcagcggagcggcgtcctgtgggacacccccagcccgcccgaggtggagcgcgccgtgctggacgacggcatctaccggatcatgcagcgcgggctgctcggccggagccaggtcggggtgggcgtgttccaggagaacgtcttccacaccatgtggcacgtgacccgcggggcggtgctgatgtaccagggcaagcggctggagccctcctgggccagcgtcaagaaggacctcatctcctacggcgggggctggcgcctgcgggggagctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgtccgggagccccatcgtcaaccgcgagggcaagatcgtgggcctctacgggaacggcgtggtcaccaccagcgggacctacgtgtccgccatcgcccaggccaaggcgagccaggagggcccgctgcccgagatcgaggacgaggtgttccggaagcgcaacctgacgatcatggacctccaccccgggtccggcaagacccggcgctacctgccggccatcgtccgggaggccatcaagcgcaagctgcgcaccctcatcctggcccccacccgggtggtggccagcgagatggcggaggccctgaagggcatgcccatccgctaccagacgaccgccgtcaagggggagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcggctacgagtggatcaccgacttccccgggaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcggccggatcgggcgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcggtcgacggggagtaccggctccgcggcgaggcccggaagaccttcgtggagctgatgcgccggggcgacctgcccgtgtggctctcctacaaggtcgccagcgaggggttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgcggccggccgccggagcgtctccggcgacctcatcctggagatcgggaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccggcggggtcaccctgttcttcctgtccggccggggcctcgggaagaccagcatcggcctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaaggggtggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgcgaggcccagaagcggaccgccgccggcatcatgaagaaccccaccgtggacggcatcgtggccatcgacctcgaccccgtcgtgtacgacgcgaagttcgagaagcagctggggcagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtgagcatggccaacatcttccggggctcctacctggcgggggccggcctcgccttcagcctgatgaagtccctcgggggcgggcgccgggggaccggcgcccagggggagaccctcggcgagaagtggaagcgccagctgaaccagctgtccaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagcccgagggcaaggtgatcgacctggggtgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccgcacgctgcgggtcctcaagatggtggagccctggctgcgcggcaaccagttctgcatcaagatcctgaacccctacatgcccagcgtggtcgagaccctcgagcagatgcagcggaagcacgggggcatgctggtgcgcaacccgctgtcccggaacagcacccacgagatgtactgggtgtcctgcgggaccggcaacatcgtcagcgcggtgaacatgacctcccgcatgctcctgaaccgcttcacgatggcccaccggaagcccacctacgagcgcgacgtggacctgggcaccgggacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcggggcaccgcccagatcatggaggtcaccgcccgctggctctgggggttcctgtcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctccacaagcaggggaagtgcgcgacctgcgtctacaacatgatgggcaagcgggagaagaagctgggggagttcggcaaggccaagggcagccgcgccatctggtacatgtggctgggggcccggttcctcgagttcgaggcgctgggcttcatgaacgaggaccactggttctcccgcgagaacagcctgtccggggtggagggcgaggggctccacaagctgggctacatcctgcgggacatcagcaagatccccggcgggaacatgtacgccgacgacaccgccggctgggacacccgcatcacggaggacgacctccagaacgaggccaagatcaccgacatcatggagccggagcacgccctgctggcgaaggccatcttcaagctcacctaccagaacaaggtggtccgcgtgcagcggcccgccaagaacgggaccgtgatggacgtcatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgcgctggactggctcgagaagtacggcgtggagcggctgaagcgcatggccatcagcggggacgactgcgtcgtgaagccgatcgacgaccggttcgccacggccctgaccgccctcaacgacatgggcaaggtgcgcaaggacatcccccagtgggagccctcccggggctggaacgactggcagcaggtccccttctgcagccaccacttccaccagctgatcatgaaggacgggcgcgagatcgtggtgccgtgccggaaccaggacgagctggtcggccgcgcgcgggtgtcccagggggccggctggagcctccgcgagaccgcctgcctgggcaagagctacgcccagatgtggcagctgatgtacttccaccggcgcgacctccggctggcggccaacgccatctgctccgccgtgcccgtcgactgggtgcccaccagccgcacgacctggtccatccacgcccaccaccagtggatgaccaccgaggacatgctgagcgtgtggaaccgcgtctggatcgaggagaacccctggatggaggacaagacgcacatctccagctgggaggacgtgccgtacctcggcaagcgggaggaccagtggtgcggctccctgatcgggctgaccgcgcgcgccacctgggccaccaacatccaggtggccatcaaccaggtccggcgcctcatcggcaacgagaactacctggactacatgaccagcatgaagcggttcaagaacgagtccgaccccgagggggccctgtggtga

SEQ ID NO: 8632 - RNA, 9879 nt, synthetic construct
  misc_feature 1..9879: note = derived and/or modified CDS sequence (opt1) from DENV-1__GU131726__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggccacgcagaacggccggctgatcaccgccaacccgatcgtcaccgacaaggagaagcccgtgaacatcgaggcggagccgcccttcggggagtcctacatcgtgatcggcgccggcgagaaggccctgaagctcagctggttcaagaaggggtccagcatcggcaagatgttcgaggccaccgcccgcggggcgcggcgcatggccatcctgggcgacacggcctgggacttcgggtccgtcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgtgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcgccaccaacatctggctgaagctgcgggacagctacacccaggtgtgcgaccaccgcctcatgtccgccgccatcaaggacagcaaggccgtgcacgcggacatgggctactggatcgagtccgagaagaacgagacctggaagctggcccgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggcggtgttcctgctcctgatcatggggcagctgacctggaacgacctcatccggctgtgcatcatggtcggcgccaacgccagcgaccgcatggggatgggcacgacctacctggccctcatggccaccttcaagatgcgcccgatgttcgcggtggggctgctgctccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggccaccctcctgagcctgaccttcatcaagacgaccctctccctgcactacgcgtggaagaccatggccatggtcctgagcatcgtgtccctcttccccctgtgcctgagcaccacgtcccagaagaccacctggctccccgtgctgctgggcagcttcgggtgcaagccgctcaccatgttcctgatcacggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcgtgctacgtgatcagcgggtccagcccggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctaccccctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaacccgaagaacgtccagaccgcccccgggaccttcaagacccccgagggcgaggtgggcgccatcgccctcgacttcaagcccgggacgagcggctccccgatcgtgaaccgcgaggggaagatcgtcggcctgtacggcaacggggtggtgaccaccagcggcacctacgtcagcgcgatcgcccaggccaaggcctcccaggaggggcccctgcccgagatcgaggacgaggtgttccggaagcgcaacctcacgatcatggacctgcacccgggcagcgggaagacccggcgctacctgcccgcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctccccggtgcgcgtgcccaactacaacatgatcatcatggacgaggcccacttcaccgaccccagctccatcgccgcgcgggggtacatcagcacccgcgtcggcatgggggaggccgccgccatcttcatgaccgccacgcccccgggctccgtggaggcgttcccccagagcaacgccgtgatccaggacgaggagcgggacatccccgagcgctcctggaacagcgggtacgagtggatcaccgacttccccggcaagaccgtctggttcgtgccgtccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccccgccggtgcctcaagcccgtcatcctgaaggacgggcccgagcgcgtgatcctggccggcccgatgcccgtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatcccggccctcttcgagcccgagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgacccgctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatcccggagcccgaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccacccggcctccgcctggacgctgtacgccgtcgcgaccaccatcatcacccccatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtgaacccgctgacgctcaccgccgccgtcctgatgctggtggcgcactacgccatcatcggccccgggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccggcccgctgaccaccctgtgggaggggtcccccggcaagttctggaacacgaccatcgccgtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagccgatccccatggccacctacgggtggaacctggtgaagctccactccggcaaggacgtcttcttcacgccgcccgagaagtgcgacaccctgctgtgcgacatcggggagagctccccgaaccccacgatcgaggagggccggaccctccgcgtgctgaagatggtggagccctggctgcgggggaaccagttctgcatcaagatcctcaacccctacatgccgagcgtcgtggagaccctggagcagatgcagcgcaagcacggcggcatgctggtgcggaaccccctctcccgcaacagcacccacgagatgtactgggtctcctgcgggaccggcaacatcgtgagcgccgtgaacatgacgtcccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagagcacgtggcactacgacgaggacaacccgtacaagacctgggcctaccacgggtcctacgaggtgaagcccagcggctccgccagcagcatggtcaacggggtggtgaagctgctcaccaagccctgggacgtcatccccatggtgacccagatcgcgatgacggacaccaccccgttcggccagcagcgcgtgttcaaggagaaggtcgacacccggacgcccaaggccaagcgcgggaccgcccagatcatggaggtgaccgcccggtggctgtggggcttcctgtcccgcaacaagaagccccggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccggcgggaacatgtacgcggacgacaccgccgggtgggacacccgcatcacggaggacgacctgcagaacgaggccaagatcaccgacatcatggagcccgagcacgccctgctcgccacctccatcttcaagctgacctaccagaacaaggtcgtgcgggtgcagcgccccgcgaagaacgggacggtcatggacgtgatcagccgccgggaccagcgcggctccggccaggtgggcacctacggcctgaacaccttcaccaacatggaggcccagctcatccggcagatggagagcgaggggatcttcctgccctccgagctggagacgccgaacctcgccgagcgcgtcctggactggctggagaagtacggcgtggagcggctcaagcgcatggccatcagcggggacgactgcgtggtcaagcccatcgacgaccggttcgccaccgcgctgaccgccctgaacgacatgggcaaggtgcgcaaggacatcccccagtgggagccctccaaggggtggaacgactggcagcaggtcccgttctgcagccaccacttccaccagctcatcatgaaggacggccgggagatcgtcgtgccctgccgcaaccaggacgagctggtgggccgggcccgcgtctcccagggggccggctggagcctgcgggagaccgcctgcctcggcaagagctacgcgcagatgtggcagctgatgtacttccaccgccgggacctgcgcctcgccgccaacgccatctgctccgcggtgcccatcgactgggtgcccacgagccggaccacctggtccatccacgcccaccaccagtggatgaccacggaggacatgctgagcgtctggaaccgcgtgtggatcgaggagaacccgtggatggaggacaagacccacgtgtccagctggggcgacgtcccctacctggggaagcgggaggaccagtggtgcggctccctcatcggcctgaccgcccgcgccacctgggccagcaacatccaggtggcgatcaaccaggtgcgccggctgatcgggaacgagaactacctcgactacatgacctccatgaagcgcttcaagaacgagggcgaccccgagggggccctgtggtga

SEQ ID NO: 8633 - RNA, 9879 nt, synthetic construct
  misc_feature 1..9879: note = derived and/or modified CDS sequence (opt1) from DENV-1__GU131727__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgtacctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacacgatcgagaccctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggccgtggagaaccaccaccacgcgacgatgctggacgtcgacctccaccccgcctccgcctggaccctgtacgccgtggccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtcaaccccctgaccctcaccgccgccgtgctgatgctggtggcccactacgcgatcatcggcccggggctccaggccaaggccacccgggaggcccagaagcgcacggccgcgggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtgagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgacggaggtgaagggctacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggacgggcaacatcgtgagcgccgtcaacatgacctcccggatgctgctgaaccgcttcaccatggcccaccgcaagcccacctacgagcgggacgtggacctcggggccggcacgcgccacgtggcggtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgccatgaccgacaccacccccttcggccagcagcgcgtcttcaaggagaaggtggacacgcggaccccgaaggcgaagcgcgggaccgcccagatcatggaggtgaccgcccggtggctgtggggcttcctgtcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtggtgcgggtccagcgccccgccaagaacgggaccgtgatggacgtgatcagccgccgggaccagcgcggctccgggcaggtcggcacctacggcctgaacaccttcacgaacatggaggcgcagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgccatcaaccaggtgcgccggctgatcgggaacgagaactacctcgactacatgacgtccatgaagcgcttcaagaacgagggcgaccccgagggggcgctgtggtga

SEQ ID NO: 8634 - RNA, 9879 nt, synthetic construct
  misc_feature 1..9879: note = derived and/or modified CDS sequence (opt1) from DENV-1__HM631850__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggggagttctgcgaggacacgatgacctacaagtgcccccgcatcaccgaggccgagcccgacgacgtggactgctggtgcaacgccaccgacacgtgggtgacctacgggacctgcagccagaccggggagcaccggcgcgacaagcggagcgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaaccccatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccccggacctgagcctggagaaggccgccgaggtgtcctgggaggaggaggccgagcacagcggcgcctcccacaacatcctcgtggaggtccaggacgacgggaccatgaagatcaaggacgaggagcgggacgacaccctgaccatcctgctcaaggcgaccctgctggccgtgagcggcgtgtaccccctctccatccccgccacgctgttcgtctggtacttctggcagaagaagaagcagcgcagcggggtgctgtgggacaccccctccccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgccgtcctgatgtaccaggggaagcgcctcgagccctcctgggcgagcgtgaagaaggacctgatctcctacggcggcgggtggcggctgcagggcagctggaacacgggggaggaggtgcaggtcatcgccgtggagcccggcaagaacccgaagaacgtgcagaccgcccccgggaccttcaagacctccgagggcgaggtcggcgccatcgccctcgacttcaagcccgggacgagcggcagccccatcgtgaaccgcgaggggaagatcgtgggcctgtacggcaacggggtcgtgaccacctccggcacctacgtgagcgcgatcgcccaggccaaggcctcccaggaggggccgctgcccgagatcgaggacgaggtcttccggaagcgcaacctcacgatcatggacctgcaccccggcagcgggaagacccggcgctacctgccggcgatcgtgcgggaggccatcaagcgcaagctccggaccctgatcctggcccccacccgcgtggtcgcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctcaagcccgtgatcctgaaggacgggcccgagcgcgtcatcctggccggccccatgccggtgacggtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgccgcgggccgccggagcgtctccggggacctgatcctggagatcggcaagctcccgcagcacctgacccagaaggcccagaacgccctggacaacctcgtgatgctgcacaacagcgagcagggcgggcgcgcctaccggcacgcgatggaggagctgcccgacaccatcgagacgctcatgctgctggccctcatcgccgtgctgaccggcggggtcaccctgttcttcctctccggccgcgggctgggcaagaccagcatcggcctgctctgcgtgatggcctccagcgtgctgctgtggatggcctccgtcgagccccactggatcgcggccagcatcatcctcgagttcttcctgatggtgctgctcatccccgagccggaccggcagcgcacgccccaggacaaccagctggcctacgtggtcatcgggctcctcttcatgatcctgacggtggccgccaacgagatgggcctgctcgagaccaccaagaaggacctggggatcggccacgtggcggtcgagaaccaccaccacgccgccatgctggacgtggacctccaccccgcctccgcctggaccctgtacgcggtggccacgaccatcatcaccccgatgatgcggcacaccatcgagaacacgaccgccaacatcagcctgaccgccatcgccaaccaggcggccatcctcatggggctggacaagggctggcccatctccaagatggacatcggcgtccccctgctcgccctggggtgctacagccaggtgaaccccctgaccctcacggccgcggtgctgatgctggtcgcccactacgccatcatcggcccggggctccaggccaaggccacccgcgaggcgcagaagcggaccgccgccggcatcatgaagaaccccaccgtggacgggatcgtggccatcgacctggaccccgtcgtgtacgacgccaagttcgagaagcagctgggccagatcatgctcctgatcctgtgcacgtcccagatcctcctgatgcgcaccacctgggcgctgtgcgagagcatcaccctcgccacgggccccctgaccaccctgtgggaggggtccccgggcaagttctggaacaccacgatcgccgtgagcatggccaacatcttccgcgggagctacctcgccggcgcgggcctggccttctccctgatgaagtccctcgggggcgggcggcgcggcaccggggcccagggcgagaccctgggcgagaagtggaagcggcagctgaaccagctctccaagagcgagttcaacacctacaagcgctccgggatcatggaggtcgaccggagcgaggccaaggagggcctgaagcgcggggagacgaccaagcacgcggtgtcccggggcaccgccaagctgcgctggttcgtggagcggaacctcgtcaagcccgaggggaaggtgatcgacctgggctgcggccgcgggggctggagctactactgcgccgggctgaagaaggtgaccgaggtcaagggctacacgaagggcgggcccggccacgaggagcccatcccgatggccacctacgggtggaacctggtgaagctccactccggcaaggacgtgttcttcatcccgcccgagaagtgcgacaccctgctgtgcgacatcggggagagctcccccaacccgaccatcgaggagggccggacgctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacctcccggatgctgctgaaccgcttcacgatggcgcaccggaagcccacctacgagcgcgacgtggacctcggggccggcacccgccacgtcgccgtggagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggcagcgcgtccagcatggtgaacggggtcgtgaagctgctcaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgccaagtggctgtggggcttcctgtcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctcgtgcaccgggagcgcgagctgcacaagcaggggaagtgcgccacgtgcgtctacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcaccgaggacgacctgcagaacgaggccaagatcacggacatcatggagccggagcacgccctgctcgcgaagtccatcttcaagctgacctaccagaacaaggtggtccgggtgcagcgccccgccaagaacgggaccgtgatggacgtcatcagccggcgcgaccagcgcggctccggccaggtgggcacctacggcctgaacacgttcaccaacatggaggcccagctcatccggcagatggagagcgaggggatcttctcccccagcgagctggagacccccaacctggccggccgcgtgctcgactggctggagaagcacggggtcgagcggctgaagcgcatggccatctccggcgacgactgcgtggtgaagccgatcgacgaccggttcgcgaccgccctcacggccctgaacgacatggggaaggtccgcaaggacatcccccagtgggagcccagcaagggctggaacgactggcagcaggtccccttctgcagccaccacttccaccagctgatcatgaaggacggccgggagatcgtggtcccgtgccgcaaccaggacgagctcgtggggcgggcccgcgtgtcccagggcgccgggtggagcctgcgggagaccgcgtgcctgggcaagtcctacgcccagatgtggcagctcatgtacttccaccgccgggacctgcgcctggccgccaacgcgatctgcagcgccgtccccgtggactgggtgcccacctcccggaccacgtggagcatccacgcccaccaccagtggatgaccaccgaggacatgctctccgtctggaaccgcgtgtggatcgaggagaacccctggatggaggacaagacccacatcagcaactggggcgacgtgccgtacctgggcaagcgggaggaccagtggtgcggctccctgatcgggctcacggcccgcgccacctgggcgaccaacatccaggtcgccatcaaccaggtgcggcgcctgatcggcaacgagaactacctggactacatgaccagcatgaagcgcttcaagaacgagtccgaccccgagggggccctctggtga

SEQ ID NO: 8635 - RNA, 9879 nt, synthetic construct
  misc_feature 1..9879: note = derived and/or modified CDS sequence (opt1) from DENV-1__KF955446__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagacctccgccggggtgaacatgtgcaccctgatcgccatggacctcggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctggcgccccacgtgggcctcgggctggagacccggaccgagacctggatgagctccgagggcgcctggaagcagatccagcgggtggagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcagcacgcaggacgagaagggggtcacccagaacggccggctgatcaccgccaaccccatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacaccccctccccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggcccgggcctcccaggaggggccgctccccgagatcgaggcggaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtgggcgcctccgagatggcggaggccctgaagggcatgcccatccggtaccagaccaccgccgtcaagagcgagcacaccgggaaggagatcgtcgacctgatgggccacgccacgttcaccatggggctcctggcccccggccgcgtgccgaactacaacatggtgatcatggacgaggcgcacttcaccgacccctcccggatcgccgcccgcgggtacatcagcacccgggtcggcatgggcgaggccgccgcgatcttcatgacggccacgccgcccgggtccgtggaggccttcccgcagagcaacgccgtgatccaggacgaggagcgcgacatccccgagcggtcctggaacagcggctacgagtggatcaccgacttccccgggaagaccgtctggttcgtgccctccatcaagagcggcaacgacatcgcgaactgcctgcgcaagaacgggaagcgggtgatccagctctcccgcaagacgttcgacaccgagtaccagaagaccaagaacaacgactgggactacgtcgtgaccacggacatcagcgagatgggcgccaacttccgggccgaccgcgtgatcgacccgcggcgctgcctgaaccccgtcatcctgaaggacggccccgagcgggtgatcctcgccgggcccatgccggtgaccgtcgcctccgcggcccagcgccggggccgcatcgggcgcaaccacaacaaggagggcgaccagtacatctacatggggcagcccctgaacaacgacgaggaccacgccccctggaccgaggccaagatgctgctcgacaacatcaacacccccgagggcatcatcccggccctgttcgagcccgagcgggagaagtccgcggccatcgacggcgagtcccgcctgcgcggggaggcccgcaagacgttcgtggagctcatgcggcgcggcgacctgcccgtctggctgagctacaaggtggcctccgaggggttccagtacagcgaccggcgctggtgcttcgacggcgagcggaccaaccaggtgctcgaggagaacatggccgtcgagatctggcccaaggagggcgagcgcaagaagctgcggccgcgctgcctggacgcgcggacctacagcgaccccctcgccctgcgcgagttcaaggagttcccgcccgggcggcgctccgtgagcggcgacctgatcctcgagatcgggaagctgccgcaccccctgacccagcggccccagaacgccctcgccacgctggtgatgtcccacaccagcgagcagggcgggcgcgcgtaccggcacgccatggaggagctgccggccaccatcgagaccctcatgctgctggccctcatcgccgtcctgaccggcggcgtgacgctgttcttcctctccgggcgcggcctggggaagaccagcatcggcctgctctgcgtgatggcgtccagcgtcctgctgtggatggcctccgtggagccccactggatcgccgccagcatcatcctcgagttcttcctgatggtgctgctcatccccgagcccgactccaacgccacccggcaggacaaccagctggcgtacgtcgtgatcgggctcctcttcatgatcctgaccgtggccgccaacgagatgggcctgctcgagacgaccaagaaggacctgggcatcgggcacgtcgccgtggagaaccaccaccacgccgcgatgctggacgtggacctccacccggccagcgcctggaccctgtacgccgtcgccaccacgatcatcacccccatgatgcgccacaccatcgagaacaccacggcgaacatctccctgaccgccatcgccaaccaggccgcgatcctcatgggcctggccaaggggtggcccatcagcaagatggacatcggcgtgcccctgctcgccctggggtgctactcccaggtgaacccgctgaccctcaccgcccccgtcctgatgctggtgccccactaccccatcatcggcccgggcctccaggccaaggcgacgcgcgaggcccagaagcggaccgccgccgggatcatgaagaaccccaccgtggacggcatcgtcgccatcgacctggaccccgtggtgtacgacgcgaagttcgagaagcagctggggcagatcatgctcctgatcctgtgcaccagccagatcctcctgatgcgcacgacctgggccctgtgcgagtccatcaccctcgccaccggccccctgacgaccctgtgggagggcagcccggggaagttctggaacaccaccatcgccgtctccatggccaacatcttccggggcagctacctcgcgggggccggcctggccttcagcctgatgaagtccctcgggggcggccgccgggggacgggcgcccagggggagaccctgggcgagaagtggaagcgccagctgaaccagctcaccaagagcgagttcaacacctacaagcggtccgggatcatggaggtggaccgcagcgaggcgaaggagggcctgaagcggggcgagacgaccaagcaccccgtgtcccgcgggaccgccaagctgcggtggttcgtcgagcgcaccctcgtgaagcccgagggcaaggtgatcgacctggggtgcggccgcggcgggtggagctactactgcgccgggctgaagaaggtcacggaggtgaaggggtacaccaagggcgggcccggccacgaggacccgatccccatggggacctacggctggaacctggtgaagctccgctccggcaaggacgtcttcttcatcccgcccgagaagtgcgacaccctgctgtgcgacatcggggagagctccccgaaccccaccatcgaggagggccggacgctccgcgtgctgaagatggtggagccctggctgcgggggaaccagttctgcatcaagatcctcaacccctacatggccagcgtcgtggagaccctggagcagatgcagcgcaagcacggcggcatgctggtgcggaacccgctctcccgcaacagcacccacgagatgtactgggtctcctgggggaccggcaacatcgtgagcgccgtgaacatgacgtcccgcatgctgctgaaccggttcaccatggcgcaccgcaagcccacctacgagcgggacgtcgacctcggggccggcacccgccacgtggccgtggagcccgaggtcgccaacctggacatcatcgggcagcggatcgagaacatcaagcacgagcacaagagcacgtggcactacgacgaggacaacccgtacaagacctgggcctaccacggctcctacgagggcaagcccagcgggtccgcgagcagcatggtgaacggcggggtgaagctgctcaccaagccctgggacggcatccccatggtcacccagatcgccatgacggacaccaccccgttcgggcagcagcgcgtgttcaaggagaaggtcgacacccggacgcccaaggccaagcgcggcaccgcccagatcatggaggtgaccgccaagtggctgtggggcttcctgtcccggaacaagaagccccgcatctgcacccgggaggagttcacgcgcaaggtgcggagcaacgcggccatcggggccgtcttcgtggacgagaaccagtggaactccgccaaggaggcggtggaggacgagcgcttctgggacctcgtccaccgggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtggagggggagggcctgcacaagctgggctacatcctccgggacatcagcaagatccccgggggcaacatgtacgccgacgacaccgccgggtgggacacccgcatcacggaggacgacctgcagaacgaggcccgcatcaccgacatcatggagccggagcacgccctgctcgcgaagtccatcttcaagctgacctaccagaacaaggtcgtgcgggtgcagcgccccgccaagaacggcaccgtcatggacgtgatcagccggcgcgaccagcgggggtccggccaggtgggcacgtacgggctgaacaccttcaccaacatggaggcccagctcatccgccagatggagagcggcgggatcttcagcccccgggagctggagacccccaacctggccgagcgcgtcctcgactgggtggagaagtacggcgtggagcggctggagcgcatggccatcagcggggacgactgcctgggcgagccgatctacgaccggttcgcgacggccctcaccgccctgaacgacatgggcaaggtccgcaaggacatcccccagtgggagccctccaaggggtggaacgactggcagcagggccccttctgcagccaccacttccaccagctgatcatgaaggacgggcgggagatcgtggtgccgtgccgcaaccaggacgagctcgtcggccgggcccgcgtgtcccagggggccggctggagcctgcgggagaccgcgtgcctgggcaagagctacgcccagatgtggcagctcatggacttccaccgccgggacctgcgcctggccgccaacgcgatctggtccgccgggcccggcgactggatccccacccgccggacgacctggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgggaggaccagtggtgcgggagcctgatcggcctcacggcccgcgccacctgggcgaccaacatccaggtggccatcaaccaggtccggcgcctgatcggcaacgagaactacctggactacatggcctccatgaagcggttcaagaacgagagcgaccccgagggggccctctggtga

SEQ ID NO: 8636 - RNA, 9879 nt, synthetic construct
  misc_feature 1..9879: note = derived and/or modified CDS sequence (opt1) from DENV-1__KF921942__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcgccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgccgggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggcggactccgggtgcgtgatcaactggaagggccgggagctgaagtgcgggagcggcatcttcgtgacgaacgaggtccacacctggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtggtcgtgggggacgtggccggcatcctggcccaggggaagaagatgatccggccccagcccatggagtacaagtacagctggaagtcctggggcaaggccaagatcatcggcgcggacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggcggtcttcttcctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgcggtgggcctgctgttccgccggctcacgtcccgcgaggtcctgctgctcaccatcgggctgagcctggtggcctccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcgtggaagaccatggccatggtcctcagcatcgtgtccctgttccccctgtgcctcagcacgacctcccagaagaccacctggctgcccgtcctgctcggcagcctggggtgcaagccgctgacgatgttcctcatcgccgagaacaagatctggggccggcgctcctggcccctgaacgaggggatcatggccgtgggcatcgtgagcatcctgctcagctccctgctgaagaacgacgtccccctcgccgggcccctgatcgcgggcggcatgctgatcgcctgctacgtgatcagcgggtccagcgccgacctctccctggagaaggccgccgaggtgagctgggaggaggaggcggagcactccggcgccagccacaacatcctggtcgaggtgcaggacgacgggaccatgaagatcaaggacgaggagcgggacgacaccctcaccatcctgctgaaggccaccctcctggccgtgtccggcgtctacccgctgagcatccccgccaccctgttcgtgtggtacttctggcagaagaagaagcagcgctccggggtgctgtgggacacccccagcccgcccgaggtcgagcgggcggtgctggacgacggcatctaccgcatcatgcagcggggcctgctcgggcgctcccaggtgggcgtcggggtgttccaggagaacgtgttccacaccatgtggcacgtcacccggggcgccgtgctgatgtaccaggggaagcgcctggagcccagctgggcctccgtgaagaaggacctcatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgcgatcgccctggacttcaagcccgggacgagcggctcccccatcgtgaaccgcgaggggaagatcgtcggcctctacggcaacggggtggtgaccaccagcggcacctacgtcagcgccatcgcccaggcgaaggcctcccaggaggggccgctgcccgagatcgaggacgaggtgttccggaagcgcaacctgacgatcatggacctccaccccggcagcgggaagacccggcgctacctgccggccatcgtgcgggaggccatcaagcgcaagctgcgcaccctcatcctggcccccacccgggtcgtggcgtccgagatggccgaggccctgaagggcatgcccatccgctaccagacgaccgccgtcaagagcgagcacaccggcaaggagatcgtcgacctcatgtgccacgccaccttcacgatgcggctgctgtcccccgtgcgcgtgccgaactacaacatgatcatcatggacgaggcgcacttcaccgaccccagctccatcgccgcccgggggtacatcagcacccgcgtcggcatgggggaggccgccgcgatcttcatgaccgccacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgcgaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgccgaccgggtgatcgacccgcgccggtgcctgaagcccgtcatcctcaaggacgggcccgagcgcgtgatcctggccggccccatgccggtgacggtcgcctccgcggcccagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgcggccatcgacggggagtaccggctccgcggcgaggcccggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggcgctgcgggagttcaaggagttcgccgccggccgccggagcgtgtccggggacctcatcctggagatcggcaagctgccgcagcacctcacccagcgcgcccagaacgcgctggacaacctggtgatgctccacaacagcgagcagggcgggcgggcctaccgccacgccatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcgtccagcgtcctcctgtggatggcctccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcacggtggcggccaacgagatgggcctgctggagaccaccaagaaggacctcgggatcggccacgtcgccgtggagaaccaccaccacgccgccatgctggacgtggacctgcaccccgcgtccgcctggaccctctacgccgtcgccacgaccatcatcaccccgatgatgcgccacaccatcgagaacacgaccgccaacatcagcctgaccgcgatcgccaaccaggccgccatcctgatggggctcgacaagggctggcccatctccaagatggacatcggcgtgcccctgctggcgctcgggtgctacagccaggtgaaccccctgaccctgacggccgccgtcctcatgctggtggcccactacgccatcatcggcccggggctgcaggcgaaggccacccgcgaggcccagaagcggaccgccgccggcatcatgaagaaccccaccgtggacgggatcgtcgcgatcgacctcgaccccgtggtgtacgacgccaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtccccgggcaagttctggaacaccacgatcgccgtcagcatggcgaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgtccaagagcgagttcaacacctacaagcggtccgggatcatggaggtggaccgcagcgaggccaaggagggcctcaagcgcggggagacgaccaagcacgccgtgtcccgcggcaccgccaagctgcggtggttcgtcgagcgcaacctggtgaagcccgaggggaaggtgatcgacctgggctgcggccgcgggggctggagctactactgcgccgggctcaagaaggtcaccgaggtgaagggctacacgaagggcggccccggccacgaggagcccatcccgatggcgacctacgggtggaacctggtgaagctgcactccggcaaggacgtcttcttcatcccgcccgagaagtgcgacaccctcctgtgcgacatcggggagagctcccccaacccgaccatcgaggagggccgcacgctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacctcccgcatgctcctgaaccgcttcacgatggcccaccggaagcccacctacgagcgcgacgtcgacctgggggccggcacccggcacgtggccgtggagcccgaggtcgcgaacctcgacatcatcggccagcgcatcgagaacatcaagcacgagcacaagagcacctggcactacgacgaggacaacccctacaagacgtgggcctaccacgggtcctacgaggtgaagccgagcggctccgccagcagcatggtgaacggggtcgtgaagctgctgaccaagccctgggacgtcatccccatggtgacccagatcgccatgaccgacacgacccccttcggccagcagcgggtgttcaaggagaaggtcgacacccgcaccccgaaggccaagcgggggacggcgcagatcatggaggtgaccgccaagtggctctggggcttcctgtcccgcaacaagaagccccggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggcgcgcatcacggacatcatggagccggagcacgccctgctggccaagtccatcttcaagctcacctaccagaacaaggtcgtgcgcgtgcagcggcccgccaagaacgggaccgtcatggacgtgatcagccgccgggaccagcgcggctccggccaggtggggacctacggcctgaacacgttcaccaacatggaggcccagctgatccggcagatggagagcgaggggatcttctcccccagcgagctcgagacccccaacctggcggagcgcgtcctggactggctcgagaagtacggcgtggagcggctgaagcgcatggccatctccggggacgactgcgtggtcaagccgatcgacgaccggttcgccaccgccctgacggccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcgcgcgtcagccagggggccggctggagcctccgggagaccgcctgcctggggaagtcctacgcccagatgtggcagctgatgtacttccaccgccgggacctccgcctggcggccaacgccatctgcagcgccgtgcccgtggactggatccccacctcccggaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctcgggaagcgcgaggaccagtggtgcggcagcctgatcggcctgacggcgcgggccacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8637 - RNA, 9879 nt, synthetic construct
  misc_feature 1..9879: note = derived and/or modified CDS sequence (opt1) from DENV-1__JF937602__SS-prME
  source 1..9879: mol_type = other RNA
agcgtgaccatgctgctcatgctgatgcccaccgccctggccttccacctcacgacccgcggcggggagccccacatgatcgtgtccaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttcctgacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctggtgcaccagatcttcggcaccgcctacggggtgctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaactacatcctgctggagaacgacatgaagctcaccgtggtggtcggggacgtggcgggcatcctggcccaggggaagaagatgatccggccccagcccatggagtacaagtacagctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctccgggacagctacacccaggtgtgcgaccaccgcctgatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacaccctctggagcaacggcgtgctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtggtcgtggacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctcgtgaagtccatggtgagcgccggcagcggcgaggtcgactccttcagcctggggctgctctgcatctccatcatgatcgaggaggtgatgcgcagccggtggtcccgcaagatgctgatgaccggcaccctggccgtgttcttcctcctgatcatggggcagctgacctggaacgacctcatccggctgtgcatcatggtcggcgcgaacgccagcgaccgcatggggatgggcacgacctacctggccctcatggccaccttcaagatgcgcccgatgttcgccgtgggcctgctgttccggcgcctcacctcccgggaggtgctgctgctcacgatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgaccttcgtccgcacgaccttctccctgcactacgcctggaagaccatggcgatggtgctcagcatcgtgtccctgttccccctgtgcctcagcaccacgtcccagaagaccacctggctgcccgtcctgctcggcagcctggggtgcaagccgctgaccatgttcctcatcgccgagaacaagatctggggccggaagtcctggcccctgaacgaggggatcatggccgtgggcatcgtgagcatcctgctcagctccctgctgaagaacgacgtccccctcgccgggcccctgatcgccggcggcatgctgatcgcgtgctacgtgatcagcgggtccagcgccgacctctccctggagaaggccgccgtggtcagctgggaggaggaggccgagcactccggcgcgagccacaacatcctggtggaggtgcaggacgacgggacgatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacgcccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacccgcggcgcggtgctgatgtaccaggggaagcggctggagcccagctgggcctccgtcaagaaggacctcatcagctacggcggcgggtggcgcctgcagggctcctggaacaccggggaggaggtccaggtgatcgccgtcgagcccggcaagaaccccaagaacgtgcagacggcccccgggaccttcaagaccagcgagggcgaggtgggcgccatcgcgctggacttcaagcccgggacctccggcagccccatcgtcaaccgggaggggaagatcgtgggcctctacggcaacggggtggtcacgaccagcggcacctacgtgtccgccatcgcccaggccaaggcgagccaggaggggcccctgccggagatcgaggacgaggtgttccgcaagcggaacctgaccatcatggacctccaccccggctccgggaagacgcgccggtacctgcccgccatcgtccgcgaggccatcaagcggaagctgcgcaccctcatcctggccccgacccgcgtggtggccagcgagatggcggaggccctgaagggcatgcccatccggtaccagaccacggccgtcaagtccgagcacaccggcaaggagatcgtggacctcatgtgccacgccaccttcaccatgcgcctgctgagccccgtgcgggtccccaactacaacatgatcatcatggacgaggcccacttcacggacccgtccagcatcgcggcccgcgggtacatctccacccgggtgggcatgggggaggccgccgccatcttcatgaccgcgacgccgcccggcagcgtggaggccttcccccagtccaacgccgtcatccaggacgaggagcgcgacatcccggagcggagctggaactccgggtacgagtggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgcgaacttccgggccgaccgcgtcatcgacccccggcgctgcctgaagccggtgatcctcaaggacgggcccgagcgggtcatcctggccggccccatgcccgtgaccgtggccagcgccgcgcagcgccgggggcgcatcggccggaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgcgagaagtccgccgcgatcgacggggagtaccgcctccggggcgaggcccgcaagaccttcgtcgagctgatgcggcgcggggacctgccggtgtggctcagctacaaggtggccagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgcggccggccggcgctccgtgagcggggacctcatcctggagatcggcaagctgccccagcacctcacccagcgggcccagaacgccctggacaacctggtcatgctccacaactccgagcagggcgggcgcgcgtaccggcacgccatggaggagctgccggacaccatcgagaccctgatgctcctggccctgatcgccgtgctcacgggcggggtgaccctgttcttcctgagcggccgcgggctcggcaagacctccatcggcctgctgtgcgtcatggccagctccgtgctcctgtggatggcgagcgtggagccccactggatcgccgcctccatcatcctggagttcttcctcatggtcctgctgatccccgagcccgaccggcagcgcaccccgcaggacaaccagctcgcctacgtggtgatcgggctgctgttcatgatcctcaccgtcgccgcgaacgagatgggcctgctggagacgaccaagaaggacctcgggatcggccacgtggccgtggagaaccaccaccacgccgccatgctggacgtcgacctgcaccccgccagcgcgtggaccctctacgccgtggccaccacgatcatcacccccatgatgcggcacaccatcgagaacaccacggccaacatctccctgaccgccatcgcgaaccaggccgccatcctgatggggctcgacaagggctggccgatcagcaagatggacatcggcgtgcccctgctggccctcgggtgctactcccaggtcaaccccctgaccctgaccgcggccgtgctcatgctggtggcccactacgccatcatcggccccgggctgcaggccaaggcgacgcgcgaggcccagaagcgcaccgccgccggcatcatgaagaacccgaccgtcgacgggatcgtggccatcgacctcgaccccgtggtctacgacgcgaagttcgagaagcagctgggccagatcatgctgctcatcctgtgcaccagccagatcctgctcatgcggacgacctgggccctgtgcgagtccatcaccctggccaccggccccctcacgaccctgtgggaggggagccccggcaagttctggaacaccaccatcgccgtgtccatggccaacatcttccgcgggagctacctggcgggcgccggcctcgccttcagcctgatgaagtccctcgggggcgggcggcgcgggacgggggcccagggcgagaccctcggcgagaagtggaagcggcagctgaaccagctgagcaagtccgagttcaacacctacaagcgcagcgggatcatggaggtggaccggtccgaggcgaaggagggcctcaagcgcggggagaccacgaagcacgccgtcagccggggcaccgccaagctgcgctggttcgtggagcggaacctggtgaagccggaggggaaggtcatcgacctgggctgcggccgcgggggctggtcctactactgcgccgggctcaagaaggtgaccgaggtgaagggctacaccaagggcgggcccggccacgaggagcccatccccatggccacgtacgggtggaacctggtcaagctgcacagcggcaaggacgtgttcttcatcccgcccgagaagtgcgacaccctcctgtgcgacatcggggagtccagccccaaccccaccatcgaggagggccggaccctgcgcgtgctcaagatggtcgagccgtggctgcgggggaaccagttctgcatcaagatcctgaacccctacatgccctccgtggtggagacgctcgagcagatgcagcgcaagcacggcggcatgctggtccggaaccccctgagccgcaactccacccacgagatgtactgggtgagctgcgggaccggcaacatcgtgtccgcggtcaacatgaccagccggatgctcctgaaccgcttcaccatggcccaccgcaagccgacgtacgagcgggacgtggacctgggggccggcacccgccacgtggccgtcgagcccgaggtggccaacctcgacatcatcggccagcggatcgagaacatcaagcacgagcacaagtccacctggcactacgacgaggacaacccctacaagacctgggcgtaccacgggagctacgaggtcaagccctccggcagcgccagctccatggtgaacggggtggtcaagctgctgacgaagccgtgggacgtgatccccatggtgacccagatcgccatgaccgacaccacgcccttcggccagcagcgcgtcttcaaggagaaggtggacacccggacccccaaggccaagcgcgggaccgcccagatcatggaggtgacggcgaagtggctctggggcttcctgagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcgcggttcctcgagttcgaggccctgggcttcatgaacgaggaccactggttcagccgcgagaactccctgagcggggtcgagggcgaggggctccacaagctgggctacatcctgcgggacatctccaagatccccgggggcaacatgtacgccgacgacacggccggctgggacacccgcatcaccgaggacgacctccagaacgaggccaagatcaccgacatcatggagcccgagcacgcgctgctggccaagagcatcttcaagctcacgtaccagaacaaggtggtgcgggtccagcgcccggccaagaacgggaccgtgatggacgtgatctcccgccgggaccagcgcggcagcgggcaggtcggcacctacggcctgaacaccttcacgaacatggaggcccagctgatccggcagatggagtccgaggggatcttcagcccctccgagctcgagacccccaacctggccggccgcgtgctggactggctcgagaagcacggggtggagcggctgaagcgcatggcgatcagcggcgacgactgcgtcgtgaagcccatcgacgaccggttcgccaccgccctgaccgccctcaacgacatggggaaggtgcgcaaggacatcccgcagtgggagccctccaagggctggaacgactggcagcaggtccccttctgcagccaccacttccaccagctgatcatgaaggacggccgggagatcgtggtgccctgccgcaaccaggacgagctggtcgggcgggcccgcgtgagccagggcgcggggtggtccctccgggagacggcctgcctgggcaagagctacgcccagatgtggcagctgatgtacttccaccgccgggacctccgcctggccgcgaacgccatctgctccgccgtgccggtcgactgggtgcccaccagccggaccacctggtccatccacgcccaccaccagtggatgacgaccgaggacatgctgagcgtgtggaaccgcgtctggatcgaggagaacccctggatggaggacaagacccacatctccagctggggcgacgtgccctacctcggcaagcgggaggaccagtggtgcggctccctgatcgggctgaccgcccgcgcgacgtgggccaccaacatccaggtggccatcaaccaggtccgccggctcctgggcaacgagaactacctggactacatgaccagcatgaagcgcttcaagaacgagtccgacccggagggggccctctggtga

SEQ ID NO: 8638 - RNA, 9879 nt, synthetic construct
  misc_feature 1..9879: note = derived and/or modified CDS sequence (opt1) from DENV-1__GU131729__SS-prME
  source 1..9879: mol_type = other RNA
agcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgccccccacgtgggcctggggctggagacccgcaccgagacctggatgagctccgagggcgcgtggaagcagatccagcgggtcgagacgtgggccctccgccacccggggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgggcaagctctgcatcgaggcgaagatctccaacaccacgaccgacagccggtgcccgacccagggcgaggccaccctggtggaggagcaggacgccaacttcgtctgccgccggacgttcgtggaccgcgggtggggcaacgggtgcggcctgttcgggaagggctccctcatcacctgcgccaagttcaagtgcgtgaccaagctggagggcaagatcgtccagtacgagaacctgaagtacagcgtgatcgtgaccgtccacacgggggaccagcaccaggtgggcaacgagtccaccgagcacgggaccaccgccaccatcacgccccaggcgcccaccaccgagatccagctcaccgactacggcgccctgacgctggactgcagcccccggaccgggctcgacttcaacgagatggtcctgctgaccatgaaggagaagtcctggctcgtgcacaagcagtggttcctggacctgccgctcccctggaccagcggcgccagcacgtcccaggagacctggaaccgccaggacctgctggtgaccttcaagaccgcccacgccaagaagcaggaggtcgtggtgctcggcagccaggagggggcgatgcacacggccctgaccggcgccaccgagatccagacctccgggacgaccaccatcttcgccggccacctgaagtgccggctcaagatggacaagctgaccctgaaggggatgagctacgtcatgtgcacgggctccttcaagctcgagaaggagctggccgagacccagcacggcaccgtgctggtgcagatcaagtacgaggggaccgacgcgccctgcaagatccccttcagcacgcaggacgagaagggcgtcacccagaacgggcgcctgatcaccgccaacccgatcgtgaccgacaaggagaagcccgtgaacatcgaggccgagccccccttcggcgagtcctacatcgtcatcggcgccggggagaaggcgctcaagctgagctggttcaagaagggctccagcatcgggaagatgttcgaggccacggcccggggcgcccgccggatggccatcctgggggacaccgcgtgggacttcggctccatcggcggggtgttcaccagcgtgggcaagctcgtccaccagatcttcgggaccgcctacggcgtgctgttctccggggtgagctggacgatgaagatcggcatcggcgtcctgctcacctggctggggctgaactcccgcagcacctccctcagcatgacctgcatcgccgtgggcctggtgacgctgtacctcggggtcatggtgcaggccgactccggctgcgtgatcaactggaaggggcgcgagctgaagtgcggcagcggcatcttcgtcaccaacgaggtgcacacctggaccgagcagtacaagttccaggccgacagcccgaagcggctgtccgcggccatcgggaaggcctgggaggagggcgtgtgcgggatccgcagcgccacccggctcgagaacatcatgtggaagcagatctccaacgagctgaaccacatcctgctcgagaacgacatgaagttcacggtcgtggtgggcgacgtcgccgggatcctggcgcagggcaagaagatgatccgcccccagcccatggagtacaagtacagctggaagtcctggggcaaggccaagatcatcggggccgacgtgcagaacaccaccttcatcatcgacggccccaacaccccggagtgccccgacgaccagcgggcctggaacatctgggaggtggaggactacgggttcggcatcttcacgaccaacatctggctgaagctccgcgacagctacacccaggtctgcgaccaccggctgatgtccgcggccatcaaggacagcaaggccgtgcacgccgacatgggctactggatcgagtccgagaagaacgagacctggaagctggcccgcgcgagcttcatcgaggtgaagacgtgcatctggcccaagtcccacaccctctggagcaacggggtcctggagtccgagatgatcatccccaagatctacggcgggccgatcagccagcacaactaccggcccggctacttcacccagaccgccgggccctggcacctgggcaagctcgagctggacttcgacctgtgcgagggcacgaccgtggtggtcgacgagcactgcgggaaccgcggcccgtccctccggaccaccacggtgaccgggaagatcatccacgagtggtgctgccgcagctgcaccctgccccccctgcggttccgcggcgaggacgggtgctggtacggcatggagatccggcccgtgaaggagaaggaggagaacctcgtcaagtccatggtgagcgccggcagcggggaggtggactccttcagcctgggcctgctctgcatctccatcatgatcgaggaggtcatgcgcagccggtggtcccgcaagatgctgatgaccgggacgctggccgtgttcttcctcctgatcatgggccagctgacctggaacgacctcatccggctgtgcatcatggtgggggccaacgcgagcgaccgcatgggcatgggcaccacctacctggccctcatggccacgttcaagatgcgcccgatgttcgccgtcgggctgctgttccggcgcctcacctcccgggaggtgctgctgctcaccatcggcctgagcctggtggcctccgtcgagctccccaacagcctggaggagctgggggacggcctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcgggagcctgggctgcaagccgctgaccatgttcctcatcgcggagaacaagatctgggggcgccggtcctggcccctgaacgagggcatcatggccgtggggatcgtgagcatcctgctcagctccctgctgaagaacgacgtccccctcgccggccccctgatcgccggcgggatgctgatcgcctgctacgtgatcagcggctccagcgcggacctctccctggagaaggccgccgaggtgagctgggaggaggaggccgagcactccggggccagccacaacatcctggtcgaggtgcaggacgacggcccgatgaagatcaaggacgaggagcgcgacgacaccctcaccatcctgctgaaggcgaccctcctggccgtgtccggggtctaccccctgagcatccccgccacgctcttcgtgtggtacttctggcagaagaagaagcagcggtccggcgtgctgtgggacacccccagcccgcccgaggtcgagcgcgccgtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcgtccgtgaagaaggacctcatcagctacggcgggggctggcgcctgcaggggtcctggaacacgggcgaggaggtccaggtgatcgccgtggagcccgggaagaacccgaagaacgtccagaccgcccccggcaccttcaagacccccgagggcgaggtgggggccatcgccctggacttcaagcccggcacgagcgggtccccgatcgtgaaccgggagggcaagatcgtcggcctctacgggaacggcgtggtgaccaccagcgggacctacgtcagcgcgatcgcccaggccaaggcctcccaggagggccccctgcccgagatcgaggacgaggtgttccgcaagcggaacctgacgatcatggacctccacccggggagcggcaagacccgccggtacctgcccgcgatcgtgcgcgaggccatcaagcggaagctgcgcaccctcatcctggcccccacccgcgtcgtggcctccgagatggccgaggcgctgaagggcatgcccatccggtaccagacgaccgccgtgaagagcgagcacaccgggaaggagatcgtcgacctcatgtgccacgccaccttcacgatgcgcctgctgtccccggtgcgggtgcccaactacaacatgatcatcatggacgaggcccacttcaccgaccccagctccatcgccgcgcgcggctacatcagcacccgggtcgggatgggcgaggccgccgccatcttcatgaccgccacgcccccggggtccgtggaggcgttcccccagagcaacgccgtgatccaggacgaggagcgcgacatccccgagcggtcctggaacagcggctacgagtggatcaccgacttccccggcaagaccgtctggttcgtgccgtccatcaagagcgggaacgacatcgccaactgcctccgcaagaacggcaagcgggtgatccagctgtcccgcaagaccttcgacacggagtaccagaagaccaagaacaacgactgggactacgtcgtgaccaccgacatcagcgagatgggggccaacttccgggcggcccgcgtgatcgacccccggcgctgcctgaagcccgtcatcctcaaggacggccccgagcgggtgatcctggccgggccgatgcccgtgacggtcgcctccgccgcgcagcgccggggccgcatcggccggaaccacaacaaggagggggaccagtacatctacatgggccagcccctgaacaacgacgaggaccacgcccactggaccgaggccaagatgctcctggacaacatcaacacccccgaggggatcatcccggccctgttcgagcccgagcgcgagaagagcgccgcgatcgacggcgagtaccgcctccggggggaggcccgcaagaccttcgtggagctgatgcggcgcggcgacctgcccgtctggctctcctacaaggtggccagcgagggcttccagtacagcgaccggcgctggtgcttcgacggggagcggaacaaccaggtgctggaggagaacatggacgtcgagatctggacgaaggagggcgagcgcaagaagctgcggccccgctggctcgacgcccggacctactccgacccgctggccctgcgcgagttcaaggagttcgcggccgggcggcgcagcgtgtccggcgacctcatcctggagatcggcaagctgccccagcacctcacccagcgggcccagaacgccctggacaacctggtgatgctccacaacagcgagcaggggggccgcgcgtaccggcacgccatggaggagctgcccgacaccatcgagacgctgatgctcctggccctgatcgccgtcctcaccgggggcgtgaccctgttcttcctgtccgggcgcggcctcggcaagaccagcatcgggctgctgtgcgtgatggcctccagcgtcctcctgtggatggcgtccgtggagccccactggatcgccgccagcatcatcctggagttcttcctcatggtgctgctgatcccggagcccgaccggcagcgcaccccccaggacaaccagctcgcctacgtcgtgatcggcctgctgttcatgatcctcacggtggccgcgaacgagatggggctgctggagaccaccaagaaggacctcggcatcgggcacgtcgccgtggagaaccaccaccacgccgccatgctggacgtggacctgcacccggcctccgcgtggaccctctacgccgtcgccacgaccatcatcacccccatgatgcggcacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtgaacccgctgaccctgacggcggccgtcctcatgctggtggcccactacgccatcatcgggcccggcctgcaggccaaggcgacccgcgaggcccagaagcgcaccgccgccgggatcatgaagaaccccaccgtggacggcatcgtcgccatcgacctcgaccccgtggtgtacgacgcgaagttcgagaagcagctgggccagatcatgctgctcatcctgtgcacgtcccagatcctgctcatgcggaccacctgggccctgtgcgagagcatcaccctggccacggggccgctcaccaccctgtgggagggctcccccgggaagttctggaacaccacgatcgccgtcagcatggccaacatcttccgcggctcctacctggcgggcgccgggctcgccttcagcctgatgaagagcctgggcgggggccggcgcgggaccggcgcccagggcgagaccctcggggagaagtggaagcggcagctgaaccagctgtccaagagcgagttcaacacctacaagcgctccggcatcatggaggtggaccggagcgaggcgaaggaggggctcaagcgcggcgagacgaccaagcacgccgtgtcccgggggaccgccaagctgcgctggttcgtcgagcggaccctggtgaagcccgagggcaaggtgatcgacctgggctgcgggcgcggcgggtggagctactactgcgccggcctcaagaaggtcacggaggtgaaggggtacaccaagggcggccccgggcacgaggagccgatccccatggccacctacggctggaacctggtgaagctgcactccgggaaggacgtcttcttcatcccccccgagaagtgcgacaccctcctgtgcgacatcggcgagagctccccgaaccccacgatcgaggaggggcggaccctgcgcgtgctcaagatggtggagccctggctgcggggcaaccagttctgcatcaagatcctgaacccctacatgccgagcgtcgtggagaccctcgagcagatgcagcgcaagcacggcgggatgctggtgcggaaccccctgtcccgcaacagcacccacgagatgtactgggtctcctgcggcaccgggaacatcgtgagcgcggtgaacatgacgtcccggatgctcctgaaccgcttcaccatggcccaccgcaagcccacctacgagcgggacgtcgacctgggcgccggcacccgccacgtggccgtggagcccgaggtcgccaacctcgacatcatcgggcagcggatcgagaacatcaagcacgagcacaagagcacgtggcactacgacgaggacaacccgtacaagacctgggcgtaccacggctcctacgaggggaagcccagcggctccgccagcagcatggggaacggcgtggtgaagctgctgaccaagccctgggacgtcatccccatggtgacccagatcgccatgacggacaccaccccgttcggccagcagcgcgtcttcaaggagaaggtggacacccggacgcccaaggccaagcgcgggaccgcccagatcatggaggtgaccgcgaagtggctctggggcttcctgtcccggaacaagaagccccgcatctgcacccgggaggagttcacgcgcaaggtccggagcaacgccgccatcggggccgtgttcgtggacgagaaccagtggaactccgcgaaggaggccgtcgaggacgagcgcttctgggacctggtgcaccgggagcgcgagctccacaagcagggcaagtgcgccacctgcgtgtacaacatgatggggaagcgggagaagaagctgggcgagttcggcaaggccaaggggagccgcgccatctggtacatgtggctgggcgcgcggttcctcgagttcgaggccctggggttcatgaacgaggaccactggttctcccgcgagaacagcctgtccggcgtcgagggggagggcctccacaagctgggctacatcctgcgggacatcagcaagatcccggggggcaacatgtacgccgacgacaccgccgggtgggacacccgcatcacggaggacgacctccagaacgaggcccggatcaccgacatcatggagcccgagcacgcgctgctggccaagtccatcttcaagctcacctaccagaacaaggtggtgcgcgtccagcgccccgccaagaacggcaccgtgatggacgtgatcagccggcgcgaccagcggggctccgggcaggtcggcacgtacgggctgaacaccttcaccaacatggaggcccagctgatccgccagatggagagcgagggcatcttctcccccagcgagctcgagaccccgaacctggccgagcgggtgctggactggctcgagaagtacggggtggagcgcctgaagcggatggcgatctccggcgacgactgcgtcgtgaagcccatcgacgaccgcttcgccacggccctgaccgccctcaacgacatgggcaaggtgcggaaggacatcccccagtgggagcccagcaaggggtggaacgactggcagcaggtcccgttctgctcccaccacttccaccagctgatcatgaaggacggccgcgagatcgtggtgccctgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggatccccacctcccgcacgacctggagcatccacgcccaccaccagtggatgaccaccgaggacatgctgtccgtgtggaaccgggtgtggatcgaggagaacccgtggatggaggacaagacgcacatcagctcctggggcgacgtcccctacctcgggaagcgcgaggaccagtggtgcggcagcctgatcgggctgaccgcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 8639 - RNA, 9879 nt, synthetic construct
  misc_feature 1..9879: note = derived and/or modified CDS sequence (opt1) from DENV-1__GU131730__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcgggccgacagcgggtgcgtcatcaactggaagggccgcgagctgaagtgcgggagcggcatcttcgtgaccaacgaggtgcacacgtggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagctgaccgtggtggtcggggacgtggcgggcatcctcgcccaggggaagaagatgatccgcccccagcccatggagtacaagtactcctggaagtcctggggcaaggccaagatcatcggcgccgacgtgcagaacaccacgttcatcatcgacgggcccaacaccccggagtgccccgacgaccagcgggcgtggaacatctgggaggtcgaggactacggcttcgggatcttcaccaccaacatctggctgaagctgcgcgactcctacacccaggtgtgcgaccaccggctcatgagcgccgccatcaaggactccaaggccgtgcacgccgacatgggctactggatcgagagcgagaagaacgagacctggaagctggcgcgcgcctccttcatcgaggtcaagacctgcatctggcccaagagccacaccctgtggtccaacggcgtgctcgagagcgagatgatcatccccaagatctacgggggcccgatctcccagcacaactaccggcccgggtacttcacgcagaccgccggcccctggcacctggggaagctggagctcgacttcgacctgtgcgagggcaccaccgtggtcgtggacgagcactgcggcaaccgcgggccgagcctgcggacgaccaccgtgaccggcaagatcatccacgagtggtgctgccgctcctgcacgctgccgcccctccggttcaagggggaggacggctgctggtacgggatggagatccgccccgtcaaggagaaggaggagaacctggtcaagagcatggtgagcgccggctccggcgaggtcgacagcttctccctcgggctgctgtgcatcagcatcatgatcgaggaggtgatgcggtcccgctggagccggaagatgctcatgaccggcaccctggccgtgttcttcctgctcatcatggggcagctgacctggaacgacctgatccgcctctgcatcatggtcggcgcgaacgcctccgaccgcatggggatgggcacgacctacctggccctgatggccaccttcaagatgcggccgatgttcgccgtgggcctcctgttccgccggctgaccagccgcgaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccggacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgtggtgtcctgggaggaggaggccgagcacagcggcgcgtcccacaacatcctggtcgaggtgcaggacgacgggacgatgaagatcaaggacgaggagcgggacgacaccctgaccatcctcctgaaggccaccctgctcgccgtgagcggcgtctacccgctgtccatccccgccaccctgttcgtgtggtacttctggcagaagaagaagcagcgcagcggggtgctctgggacacgcccagcccgcccgaggtcgagcgggccgtgctggacgacggcatctaccgcatcatgcagcggggcctgctggggcgcagccaggtgggcgtcggggtgttccaggagaacgtgttccacaccatgtggcacgtcacccggggcgcggtgctcatgtaccaggggaagcgcctggagccctcctgggccagcgtgaagaaggacctgatctcctacggcggcgggtggcggctccagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgcgaggggaagatcgtcggcctgtacggcaacggggtggtgacgacctccggcacctacgtcagcgccatcgcccaggccaaggcgtcccaggaggggcccctcccggagatcgaggacgaggtgttccggaagcgcaacctgaccacgatggacctgcaccccggcagcgggaagacccggcgctacctccccgccatcgtgcgggaggccatcaagcgcaagctgcgcaccctgatcctcgccccgacccgggtcgtggcctccgagatggcggaggccctgaagggcatgcccatccgctaccagacgaccgccgtcaagagcgagcacaccggcaaggagatcgtcgacctgatgtgccacgccaccttcacgatgcggctcctgtcccccgtgcgcgtgcccaactacaacatgatcatcatggacgaggcccacttcaccgacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagaccttcgacacggagtaccagaagaccaagaacaacgactgggactacgtcgtgaccaccgacatcagcgagatgggcgcgaacttccgcgccgaccgggtgatcgacccccgccggtgcctgaagccggtcatcctgaaggacgggcccgagcgcgtgatcctcgccggccccatgcccgtcacggtggcctccgccgcgcagcggcgcgggcggatcggccgcaacccgaacaaggagggcgaccagtacatctacatggggcagcccctgaacaacgacgaggaccacgccccctggaccgaggccaagatgctgctcgacaacatcaacacccccgagggcatcatcccggccctgttcgagcccgagcgcgagaagtccgccgcgatcgacggggagtaccggctgcgcggcgaggcccggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggacgaaggagggggagcggaagaagctgcgcccccggtggctggacgcccgcacctactccgacccgctcgccctgcgggagttcaaggagttcgcggccggccgccggagcgtgtccggggacctgatcctcgagatcggcaagctgccccagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtcctgaccggcggggtgaccctcttcttcctgtccggccgggggctgggcaagaccagcatcggcctcctgtgcgtgatggcctccagcgtcctgctctggatggcgtccgtggagccccactggatcgccgccagcatcatcctggagttcttcctgatggtgctcctgatcccggagcccgaccgccagcggacgccccaggacaaccagctggcctacgtcgtgatcgggctcctgttcatgatcctgacggtggccgcgaacgagatgggcctcctggagaccaccaagaaggacctggggatcggccacgtcgccgtggagaaccaccaccacgccgccatgctcgacgtggacctgcacccggcctccgcgtggaccctgtacgccgtcgccacgaccatcatcacccccatgatgcgccacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtgaacccgctcaccctgacggcggccgtcctgatgctcgtggcccactacgccatcatcggccccgggctgcaggccaaggcgacccgcgaggcccagaagcggaccgccgccggcatcatgaagaaccccaccgtggacgggatcgtcgccatcgacctggaccccgtggtgtacgacgcgaagttcgagaagcagctcggccagatcatgctgctgatcctctgcacgtcccagatcctgctgatgcgcaccacctgggccctctgcgagagcatcaccctggccacgggcccgctgaccaccctctgggaggggtcccccggcaagttctggaacaccacgatcgccgtcagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtggaccgcagcgaggcgaaggagggcctgaagcgcggggagacgaccaagcacgccgtgtcccgcggcaccgccaagctccggtggttcgtcgagcgcaacctggtgaagcccgaggggaaggtgatcgacctgggctgcggccgcggcgggtggagctactactgcgccgggctgaagaaggtcaccgaggtgaaggggtacacgaagggcgggcccggccacgaggagccgatccccatggccacctacgggtggaacctcgtgaagctgcactccggcaaggacgtcttcttcatcccgcccgagaagtgcgacaccctgctctgcgacatcggggagagctccccgaaccccaccatcgaggagggccgcacgctgcgggtgctgaagatggtggagccctggctccgcgggaaccagttctgcatcaagatcctgaacccctacatgccgagcgtcgtggagaccctggagcagatgcagcggaagcacggcggcatgctcgtgcgcaaccccctgtcccggaacagcacccacgagatgtactgggtctcctgcgggaccggcaacatcgtgagcgcggtgaacatgacctcccgcatgctgctcaaccgcttcacgatggcccaccggaagcccacctacgagcgcgacgtcgacctgggggccggcacccggcacgtggccgtggagcccgaggtcgccaacctggacatcatcggccagcgcatcgagaacatcaagcacgagcacaagagcacctggcactacgacgaggacaacccgtacaagacgtgggcgtaccacgggtcctacgaggtgaagcccagcggcagcgcctccagcatggtcaacggggtggtgaagctcctgaccaagccctgggacgtcatccccatggtgacccagatcgccatgaccgacacgaccccgttcggccagcagcgggtgttcaaggagaaggtcgacacccgcacccccaaggccaagcgggggacggcccagatcatggaggtgaccgcgaagtggctgtggggcttcctctcccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgcgctcctggccaagtccatcttcaagctgacctaccagaacaaggtcgtgcgcgtgcagcgccccgccaagaacgggaccgtcatggacgtgatcagccggcgcgaccagcggggctccggccaggtgggcacctacggcctcaacacgttcaccaacatggaggcccagctgatccgccagatggagagcgaggggatcttctcccccagcgagctggagaccccgaacctcgccggccgggtcctggactggctggagaagcacggggtggagcgcctcaagcggatggcgatctccggcgacgactgcgtggtcaagcccatcgacgaccgcttcgccaccgccctgacggccctgaacgacatggggaaggtgcggaaggacatcccccagtgggagcccagcaagggctggaacgactggcagcaggtcccgttctgcagccaccacttccaccagctcatcatgaaggacggccgcgagatcgtcgtgccctgccggaaccaggacgagctggtggggcgcgcccgggtctcccagggcgcggggtggagcctgcgcgagaccgcctgcctcggcaagtcctacgcccagatgtggcagctgatgtacttccaccggcgcgacctgcggctcgccgcgaacgccatctgcagcgccgtgcccgtggactgggtccccacctcccgcaccacgtggagcatccacgcccaccaccagtggatgaccaccgaggacatgctgtccgtgtggaaccgggtgtggatcgaggagaacccgtggatggaggacaagacccacatcagctcctggggcgacgtcccctacctgggcaagcgcgaggaccagtggtgcggcagcctcatcgggctgacggcccgcgcgacctgggccaccaacatccaggtggccatcaaccaggtgcggcgcctgctcggcaacgagaactacctggactacatgacctccatgaagcggttcaagaacgagagcgaccccgagggggccctgtggtga

SEQ ID NO: 8640 - RNA, 9879 nt, synthetic construct
  misc_feature 1..9879: note = derived and/or modified CDS sequence (opt1) from DENV-1__GU131731__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtgggcctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcacccacaacaaggagggcgaccagtacatcagcatggggcagcccctcaacaccgccgaggaccacgcgccctggacggaggccaagatgctgctggacaacatcaacacccccgagggcatcatcccggccctcttcgagcccgagcgggagaagtccgccgccatcgacggggagtaccgcctgcgcggcgaggcgcggaagaccttcgtcgagctgatgcgccgcggggacctccccgtgtggctgagctacaaggtggccagcgagggcttccagtactccgaccgccggtggtgcttcgacggcgagcgcaacaaccaggtcctggaggagaacatggacgtggagatctggaccaaggagggggagcggaagaagctccgcccccggtggctggacgcccgcacgtacagcgacccgctggccctccgggagttcaaggagttcgccgcgggccgccggtccgtgagcggggacctgatcctggagatcggcaagctcccccagcacctgacccagcgcgcccagaacgccctggacaacctcgtcatgctgcacaactccgagcagggcgggcgggcctaccgccacgcgatggaggagctgcccgacaccatcgagaccctcatgctgctggccctcatcgccgtgctgaccggcggggtgacgctgttcttcctcagcggccgggggctgggcaagacctccatcggcctgctctgcgtcatggccagctccgtgctgctgtggatggccagcgtggagccccactggatcgcggcctccatcatcctcgagttcttcctgatggtcctgctcatcccggagcccgaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccacccggccagcgcctggaccctgtacgccgtggcgacgaccatcatcacccccatgatgcgccacaccatcgagaacacgaccgccaacatctccctgaccgccatcgccaaccaggccgcgatcctcatggggctggacaagggctggcccatcagcaagatggacatcggcgtgcccctgctcgccctggggtgctactcccaggtcaacccgctgaccctcacggccgccgtgctgatgctggtggcgcactacgccatcatcggccccgggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgagccagatcctcctgatgcgcaccacctgggccctgtgcgagtccatcaccctcgcgacgggcccgctgaccaccctgtgggaggggagccccggcaagttctggaacaccacgatcgccgtgtccatggccaacatcttccgggggagctacctcgccggcgccggcctggcgttcagcctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagaccacgcgccacgccgtcagccggggcaccgcgaagctgcgctggttcgtggagcggaacctggtgaagcccgaggggaaggtcatcgacctcggctgcggccgcgggggctggtcctactactgcgccgggctgaagaaggtgaccgaggtgaagggctacaccaagggcgggcccggccacgaggacccgatccccatggccacgtacgggtggaacctggtcaagctccacagcggcaaggacgtgttcttcacgccgcccgagaagtgcgacaccctgctgtgcgacatcggggagtccagcccgaaccccaccatcgaggagggccggaccctccgcgtgctgaagatggtcgagccctggctgcgggggaaccagttctgcatcaagatcctcaacccctacatgccgtccgtggtggagacgctggagcagatgcagcgcaagcacggcggcatgctggtccggaaccccctcagccgcaactccacccacgagatgtactgggtgagctgcgggaccggcaacatcgtgtccgccgtcaacatgaccagccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagtccacctggcactacgacgaggacaacccgtacaagacgtgggcctaccacgggagctacgaggtcaagccctccggcagcgccagctccatggtgaacggggtggtcaagctgctcaccaagccctgggacgtgatccccatggtgacccagatcgcgatgaccgacacgaccccgttcggccagcagcgcgtcttcaaggagaaggtggacacccggacccccaaggccaagcgcgggacggcccagatcatggaggtgaccgcccggtggctgtggggcttcctgagccgcaacaagaagccccggatctgcacccgcgaggagttcacccggaaggtccgctccaacgccgcgatcggcgccgtgttcgtggacgagaaccagtggaacagcgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgcggacgacaccgccggctgggacacccgcatcaccgaggacgacctgcagaacgaggccaagatcacggacatcatggagcccgagcacgccctgctcgccaccagcatcttcaagctgacctaccagaacaaggtggtgcgggtccagcgccccgcgaagaacgggaccgtgatggacgtgatctcccgccgggaccagcgcggcagcgggcaggtcggcacgtacggcctgaacaccttcaccaacatggaggcccagctcatccggcagatggagtccgaggggatcttcctgcccagcgagctggagaccccgaacctcgccgagcgcgtgctggactggctggagaagtacggcgtggagcggctcaagcgcatggccatctccggggacgactgcgtcgtgaagcccatcgacgaccggttcgccacggcgctgaccgccctgaacgacatgggcaaggtgcgcaaggacatcccccagtgggagcccagcaaggggtggaacgactggcagcaggtcccgttctgctcccaccacttccaccagctcatcatgaaggacggccgggagatcgtggtgccctgccgcaaccaggacgagctggtcggccgggcccgcgtgagccagggggccggctggagcctgcgggagaccgcctgcctcgggaagtcctacgcgcagatgtggcagctgatgtacttccaccgccgggacctgcgcctcgccgccaacgccatctgcagcgcggtgcccgtcgactgggtgcccacctcccggacgacctggagcatccacgcccaccaccagtggatgaccaccgaggacatgctgtccgtgtggaaccgcgtctggatcgaggagaacccgtggatggaggacaagacccacgtgagctcctggggcgacgtgccctacctggggaagcgggaggaccagtggtgcggcagcctcatcggcctgacggcccgcgccacctgggcctccaacatccaggtcgcgatcaaccaggtgcgccggctgatcgggaacgagaactacctcgactacatgaccagcatgaagcgcttcaagaacgagggcgaccccgagggggccctgtggtga

SEQ ID NO: 8641 - RNA, 9879 nt, synthetic construct
  misc_feature 1..9879: note = derived and/or modified CDS sequence (opt1) from DENV-1__GU131733__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctggcgccccacgtgggcctcgggctggagacccgcaccgagacctggatgagctccgagggcgcctggaagcagatccagcgggtcgagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggcccgggcctcccaggaggggccgctccccgagatcgaggacgaggtgttccgcaagcggaacctgaccatcatggacctgcaccccggcagcgggaagacccgccggtacctcccggcgatcgtccgcgaggccatcaagcgcaagctgcggaccctgatcctcgcccccacgcgcgtggtggcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtgatcctcgccggccccatgccggtcaccgtggcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtgtccggggacctgatcctcgagatcggcaagctgccgcagcacctgacccagcgggcccagaacgccctcgacaacctggtcatgctgcacaacagcgagcagggcgggcgcgcctaccggcacgcgatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccggcagcgcacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgggaggcgcagaagcgcaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcggaccacctgggcgctctgcgagagcatcacgctggccaccggccccctgaccaccctctgggaggggtccccgggcaagttctggaacacgaccatcgccgtgagcatggccaacatcttccgcgggtcctacctggccggcgcgggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggccaaggagggcctgaagcgcggggagaccaccaagcacgcggtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgccgtcaacatgacgtcccgcatgctgctcaaccggttcaccatggcgcaccgcaagcccacctacgagcgggacgtggacctgggggccggcacccgccacgtggccgtcgagcccgaggtggccaacatcgacatcatcggccagcggatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgccaagtggctgtggggcttcctgtcccggaacaagaagccccgcatctgcacccgggaggagttcacgcgcaaggtccggagcaacgcggccatcggcgccgtgttcgtggacgagaaccagtggaactccgccaaggaggcggtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgccggctgggacacccgcatcacggaggacgacctgcagaacgaggcccgcatcaccgacatcatggagccggagcacgccctgctcgcgaagtccatcttcaagctgacctaccagaacaaggtggtgcgggtccagcgccccgccaagaacgggaccgtgatggacgtgatcagccggcgcgaccagcggggctccgggcaggtcggcacgtacggcctgaacaccttcaccaacatggaggcccagctcatccgccagatggagagcgaggggatcttctcccccagcgagctggagacccccaacctggccgagcgggtgctcgactggctggagaagtacggcgtggagcgcctgaagcggatggccatctccggggacgactgcgtcgtgaagccgatcgacgaccgcttcgcgacggccctcaccgccctgaacgacatgggcaaggtgcggaaggacatcccccagtgggagcccagcaaggggtggaacgactggcagcaggtccccttctgctcccaccacttccaccagctgatcatgaaggacggccgcgagatcgtggtgccgtgccggaaccaggacgagctcgtcggccgcgcccgggtgagccagggggccggctggagcctgcgcgagaccgcgtgcctggggaagtcctacgcccagatgtggcagctcatgtacttccaccggcgcgacctgcggctggccgccaacgcgatctgcagcgccgtgcccgtcgactggatccccacctcccgcacgacctggagcatccacgcccaccaccagtggatgaccaccgaggacatgctctccgtgtggaaccgcgtgtggatcgaggagaacccctggatggaggacaagacgcacatcagctcctggggcgacgtcccgtacctggggaagcgggaggaccagtggtgcggcagcctgatcggcctcaccgcccgcgccacctgggcgaccaacatccaggtggccatcaaccaggtgcggcgcctgatcgggaacgagaactacctggactacatgacctccatgaagcggttcaagaacgagagcgaccccgagggcgccctctggtga

SEQ ID NO: 8642 - RNA, 9879 nt, synthetic construct
  misc_feature 1..9879: note = derived and/or modified CDS sequence (opt1) from DENV-1__GU131734__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatgacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgacagcttcaagctggagaaggaggtggcggagacccagcacgggacggtgctcgtccagatcaagtacgagggcaccgacgccccctgcaagatccccttctccacccaggacgagaagggcgtgacccagaacgggcggctgatcacggccaacccgatcgtgaccgacaaggagaagcccgtcaacatcgaggccgagccgcccttcggcgagagctacatcgtgatcggggcgggcgagaaggccctgaagctgtcctggttcaagaagggcagctccatcgggaagatgttcgaggccaccgcccgcggcgcccggcgcatggcgatcctcggggacaccgcctgggacttcggcagcatcgggggcgtgttcacgtccgtcggcaagctggtgcaccagatcttcgggaccgcctacggcgtgctgttcagcggggtctcctggaccatgaagatcggcatcggggtgctcctgacctggctgggcctcaacagccgctccacgagcctgtccatgacctgcatcgccgtgggcctggtcaccctctacctgggggtgatggtgcaggccgacagcggctgcgtcatcaactggaaggggcgggagctgaagtgcggcagcgggatcttcgtgaccaacgaggtgcacacgtggaccgagcagtacaagttccaggcggactccccgaagcgcctcagcgccgccatcggcaaggcctgggaggagggcgtctgcgggatccggtccgccacccgcctggagaacatcatgtggaagcagatcagcaacgagctgaaccacatcctcctggagaacgacatgaagttcaccgtggtggtcggcgacgtggcggggatcctggcccagggcaagaagatgatccggccccagcccatggagtacaagtactcctggaagtcctgggggaaggccaagatcatcggcgccgacgtgcagaacaccacgttcatcatcgacggccccaacaccccggagtgccccgacgaccagcgcgcgtggaacatctgggaggtcgaggactacgggttcggcatcttcaccaccaacatctggctcaagctgcgggactcctacacccaggtgtgcgaccaccgcctgatgagcgccgccatcaaggactccaaggccgtgcacgccgacatggggtactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacggcgggccgatctcccagcacaactaccgccccggctacttcacgcagaccgccgggccctggcacctcggcaagctggagctggacttcgacctctgcgaggggaccaccgtggtcgtggacgagcactgcggcaaccggggcccgagcctgcgcacgaccaccgtgaccgggaagatcatccacgagtggtgctgccggtcctgcacgctgccgcccctgcgcttcaagggcgaggacgggtgctggtacggcatggagatccggcccgtcaaggagaaggaggagaacctggtcaagagcatggtgagcgccgggtccggcgaggtcgacagcttctccctgggcctcctgtgcatcagcatcatgatcgaggaggtgatgcgctcccggtggagccgcaagatgctgatgaccgggaccctcgccgtgttcttcctgctgatcatgggccagctcacctggaacgacctgatccggctgtgcatcatggtcggggcgaacgcctccgaccgcatgggcatggggacgacctacctcgccctgatggccaccttcaagatgcgcccgatgttcgccgtgggcctcctgttccggcgcctgaccagccgggaggtgctgctcctgacgatcggcctgtccctcgtcgcgagcgtggagctgcccaactccctggaggagctcggggacggcctggccatggggatcatgatcctgaagctcctgatcgacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctgggctgcaagccgctcaccatgttcctgatcgccgagaacaagatctgggggcgcaagagctggcccctgaacgagggcatcatggccgtcgggatcgtgagcatcctcctgtccgccctgctcaagaacgacgtgcccctggccggccccctgatcgccggcgggatgctcatcgcctgctacgtcatcagcgggtccagcgccgacctgtccctggagaaggccgccgaggtgagctgggaggaggaggcggagcactccggggccagccacaacatcctcgtggaggtccaggacgacggcaccatgaagatcaaggacgaggagcgggacgacacgctgaccatcctgctcaaggccaccctgctggccgtgtccggggtgtacccgctcagcatccccgccaccctgttcgtctggtacttctggcagaagaagaagcagcgctccggcgtgctgtgggacacccccagcccgcccgaggtggagcgggcggtcctcgacgacgggatctaccgcatcatgcagcggggcctgctgggccgctcccaggtgggggtgggcgtcttccaggagaacgtgttccacacgatgtggcacgtgacccgcggggcggtcctgatgtaccagggcaagcggctcgagcccagctgggcctccgtgaagaaggacctgatcagctacgggggcggctggcggctgcaggggtcctggaacaccggcgaggaggtgcaggtcatcgccgtggagcccgggaagaaccccaagaacgtgcagaccgcccccggcacgttcaagaccagcgagggggaggtcggcgcgatcgccctcgacttcaagcccggcacctccgggagccccatcgtgaaccgcgagggcaagatcgtggggctgtacggcaacggcgtcgtgaccacgagcgggacctacgtgtccgccatcgcccaggcgaaggccagccaggagggccccctgccggagatcgaggacgaggtcttccggaagcgcaacctcaccatcatggacctgcaccccgggtccggcaagacccggcgctacctgcccgccatcgtgcgggaggccatcaagcgcaagctccggacgctgatcctggccccgacccgcgtggtcgcgagcgagatggccgaggccctcaaggggatgcccatccgctaccagaccaccgccgtgaagtccgagcacacgggcaaggagatcgtggacctgatgtgccacgccaccttcaccatgcggctgctcagccccgtccgcgtgcccaactacaacatgatcatcatggacgaggcgcacttcaccgacccgtccagcatcgccgcccggggctacatctccacgcgcgtggggatgggcgaggccgccgcgatcttcatgaccgccacgccgcccgggagcgtcgaggccttcccccagtccaacgccgtgatccaggacgaggagcgggacatcccggagcgcagctggaactccggctacgagtggatcaccgacttccccgggaagacggtgtggttcgtccccagcatcaagtccggcaacgacatcgcgaactgcctgcggaagaacggcaagcgcgtgatccagctgagccggaagaccttcgacaccgagtaccagaagaccaagaacaacgactgggactacgtggtcacgaccgacatctccgagatgggggccaacttccgcgccgaccgggtgatcgacccccgccggtgcctcaagccggtgatcctgaaggacggccccgagcgcgtcatcctggccgggcccatgcccgtgaccgtcgccagcgcggcccagcggcgcggccggatcgggcgcaaccacaacaaggagggcgaccagtacatctacatgggccagccgctcaacaacgacgaggaccacgcccactggaccgaggccaagatgctgctggacaacatcaacacgcccgaggggatcatccccgccctcttcgagcccgagcgggagaagtccgcggccatcgacggcgagtaccgcctgcgcggggaggcccggaagaccttcgtggagctgatgcgccggggcgacctcccggtgtggctgagctacaaggtcgccagcgaggggttccagtactccgaccgccggtggtgcttcgacggcgagcgcaacaaccaggtgctggaggagaacatggacgtggagatctggaccaaggagggcgagcggaagaagctccgcccccggtggctggacgcccgcacctacagcgaccccctggcgctccgggagttcaaggagttcgccgccgggcgccggtccgtcagcggcgacctgatcctggagatcgggaagctcccccagcacctgacgcagcgcgcccagaacgcgctggacaacctcgtgatgctgcacaactccgagcagggcggccgggcctaccgccacgccatggaggagctgccggacaccatcgagaccctcatgctgctggccctcatcgccgtgctgaccgggggcgtcacgctgttcttcctcagcgggcggggcctggggaagacctccatcggcctgctctgcgtgatggcgagctccgtgctgctgtggatggccagcgtcgagccccactggatcgccgcctccatcatcctcgagttcttcctgatggtgctgctcatccccgagcccgaccgccagcggaccccgcaggacaaccagctggcctacgtggtcatcggcctcctcttcatgatcctgaccgtggcggccaacgagatggggctgctcgagaccacgaagaaggacctgggcatcgggcacgtggccgtcgagaaccaccaccacgccgccatgctggacgtggacctccaccccgcgagcgcctggaccctgtacgccgtggccaccaccatcatcacgcccatgatgcgccacaccatcgagaacaccaccgccaacatctccctgacggcgatcgccaaccaggccgccatcctcatgggcctggacaaggggtggccgatcagcaagatggacatcggcgtccccctgctcgcgctgggctgctactcccaggtgaaccccctgaccctcaccgccgccgtgctgatgctggtcgcccactacgccatcatcgggcccggcctccaggcgaaggccacccgggaggcccagaagcgcacggccgccgggatcatgaagaacccgaccgtggacggcatcgtggcgatcgacctggaccccgtcgtgtacgacgccaagttcgagaagcagctggggcagatcatgctcctgatcctgtgcaccagccagatcctcctgatgcgcaccacgtgggccctgtgcgagtccatcaccctcgccaccggccccctgaccacgctgtgggagggcagccccgggaagttctggaacaccaccatcgccgtgtccatggcgaacatcttccggggcagctacctcgccggggccggcctggccttcagcctgatgaagtccctcggcgggggccgccgggggaccggcgcgcagggggagacgctgggcgagaagtggaagcgccagctgaaccagctcagcaagtccgagttcaacacctacaagcggagcggcatcatggaggtcgaccgctccgaggccaaggaggggctgaagcggggcgagaccaccaagcacgccgtgagccgcgggacggccaagctgcggtggttcgtggagcgcaacctcgtcaagccggagggcaaggtgatcgacctggggtgcggccggggcgggtggtcctactactgcgccggcctgaagaaggtgaccgaggtcaaggggtacaccaagggcgggcccggccacgaggagcccatccccatggcgacctacggctggaacctggtgaagctccacagcgggaaggacgtgttcttcatcccgcccgagaagtgcgacacgctgctgtgcgacatcggcgagtccagccccaaccccaccatcgaggaggggcgcaccctccgggtcctgaagatggtggagccgtggctgcgcggcaaccagttctgcatcaagatcctcaacccctacatgccctccgtggtcgagaccctggagcagatgcagcggaagcacgggggcatgctggtgcgcaaccccctcagccggaactccacgcacgagatgtactgggtgagctgcggcaccgggaacatcgtctccgccgtgaacatgaccagccgcatgctgctgaaccggttcaccatggcccaccgcaagccgacctacgagcgcgacgtggacctcggcgccgggacgcggcacgtcgccgtggagcccgaggtggcgaacctggacatcatcggccagcgcatcgagaacatcaagcacgagcacaagtccacctggcactacgacgaggacaacccctacaagacctgggcctaccacggcagctacgaggtcaagccctccgggagcgccagctccatggtgaacggcgtcgtgaagctgctcaccaagccgtgggacgtgatccccatggtcacgcagatcgccatgaccgacaccacccccttcgggcagcagcgggtgttcaaggagaaggtggacacgcgcacccccaaggccaagcggggcaccgcgcagatcatggaggtcaccgccaagtggctgtgggggttcctgagccgcaacaagaagccgcggatctgcacgcgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggctcccgggcgatctggtacatgtggctcggggcccgcttcctggagttcgaggccctgggcttcatgaacgaggaccactggttcagccgggagaactccctcagcggcgtggagggggagggcctgcacaagctggggtacatcctccgcgacatctccaagatccccggcgggaacatgtacgccgacgacaccgccggctgggacacgcggatcaccgaggacgacctgcagaacgaggcgaagatcaccgacatcatggagcccgagcacgccctgctcgccaagagcatcttcaagctgacctaccagaacaaggtggtccgcgtgcagcggccggccaagaacggcacggtgatggacgtcatctcccgccgcgaccagcgggggagcggccaggtggggacctacggcctgaacaccttcaccaacatggaggcccagctcatccgccagatggagtccgagggcatcttcagcccctccgagctggagacgcccaacctggcggggcgggtgctcgactggctggagaagcacggcgtcgagcgcctgaagcggatggccatcagcggggacgactgcgtggtgaagcccatcgacgaccgcttcgccgccgccctcaccgcgctgaacgacatgggcaaggtccggaaggacatcccgcagtgggagccctccaaggggtggaacgactggcagcaggtccccttctgcagccaccacttccaccagctgatcatgaaggacggccgcgagatcgtggtcccctgccggaaccaggacgagctcgtgggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgccgtcccggtggactgggtgcccaccagccgcacgacctggtccatccacgcgcaccaccagtggatgaccaccgaggacatgctcagcgtctggaaccgggtgtggatcgaggagaacccctggatggaggacaagacgcacatctccagctggggcgacgtgccctacctggggaagcgcgaggaccagtggtgcggctccctgatcggcctcaccgcccgggccacctgggccaccaacatccaggtcgccatcaaccaggtgcgccgcctgatcgggaacgagaactacctggactacatgacgagcatgaagcggttcaagaacgagtccgacccggagggcgcgctctggtga

SEQ ID NO: 8643 - RNA, 9879 nt, synthetic construct
  misc_feature 1..9879: note = derived and/or modified CDS sequence (opt1) from DENV-1__GU131738__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcacgctcatcgccatggacctgggcgagctgtgcgaggacaccatgacctacaagtgcccccgcatcaccgaggccgagcccgacgacgtggactgctggtgcaacgccacggacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccgtgggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcacggagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccaccctgctggcggtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcctccgtcaagaaggacctgatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctcgacttcaagcccgggacgagcggctcccccatcgtcaaccgcgaggggaagatcgtgggcctgtacggcaacggggtggtcaccaccagcggcacctacgtgagcgccatcgcgcaggccaaggcctcccaggaggggccgctgcccgagatcgaggacgaggtgttccggaagcgcaacctcacgatcatggacctgcaccccggcagcgggaagacccggcgctacctgccggccatcgtccgggaggcgatcaagcgcaagctccggaccctgatcctggcccccacccgcgtggtggcctccgagatggccgaggccctcaagggcatgcccatccgctaccagacgaccgcggtcaagagcgagcacaccggcaaggagatcgtggacctgatgtgccacgccaccttcacgatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgggcgctcctggaacagcggctacgagtggatcaccgacttccccggcaagaccgtgtggttcgggcccaccatcaagtccggcaacgacatcgccaactgcctgcggaagaacgggaagcgcgtgatccagctgagccggaagacgttcgacaccgagtaccagaagaccaagaacaacgactgggactacgtcggcaccacggacatctccgagatgggggccaacttccgcgccgaccgggtgatcgacccgcgccggtgcctcaagcccgtgatcctgaaggacggccccgagcgcgtcatcctggcgggccccatgccggtgaccgtcgccagcgccgcccagcggcgcgggcggatcggccgcaaccacaacaaggagggggaccagtacatctacatgggccagcccctcaacaacgacgaggaccacgcccactggaccgaggcgaagatgctgctggacaacatcaacacccccgaggggatcatccccgccctcttcgagccggagcgggagaagtccgccgccatcgacggcgagtaccgcctgcgcggcgaggcccggaagacgttcgtggagctgatgcgccgcggggacctccccgtgtggctgagctacaaggtcgcgtccgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctacagcgaccccctggccctccgggagttcaaggagttcgccgccggccgccggtccgtcagcggggacctgatcctggagatcggcaagctcccgcagcacctgacccagcgcgcgcagaacgccctggacaacctcgtgatgctgcacaactccgagcagggcgggcgggcctaccgccacgccatggaggagctgcccgacacgatcgagaccctcatgctgctggcgctcatcgccgtgctgaccgggggcgtcaccctgttcttcctcagcggccgggggctgggcaagacctccatcgggctgctctgcgtgatggccagctccgtgctgctgtggatggccagcgtcgagccccactggatcgccgcgtccatcatcctcgagttcttcctgatggtgctgctcatccccgagccggaccgccagcggacgccccaggacaaccagctggcctacgtggtcatcggcctcctcttcatgatcctgaccgtggccgccaacgagatggggctgctcgagaccaccaagaaggacctgggcatcggccacgtggccgtcgagaaccaccaccacgcgacgatgctggacgtggacctccaccccgccagcgcctggaccctgtacgccgtggccaccaccatcatcacgccgatgatgcgccacaccatcgagaacaccaccgcgaacatctccctgacggccatcgccaaccaggccgccatcctcatggggctggacaagggctggcccatcagcaagatggacatcggggtccccctgctcgcgctgggctgctactcccaggtgaaccccctgaccctcaccgccgccgtgctgatgctggtcgcccactacgcgatcatcgggccgggcctccaggccaaggccacccgggaggcccagaagcgcacggccgcgggcatcatgaagaaccccaccgtggacgggatcgtggccatcgacctggaccccgtcgtgtacgacgccaagttcgagaagcagctgggccagatcatgctcctgatcctgtgcaccagccagatcctcctgatgcgcaccacgtgggccctgtgcgagtccatcaccctcgccaccgggcccctgaccacgctgtgggagggcagcccgggcaagttctggaacaccaccatcgcggtgtccatggccaacatcttccgggggagctacctcgccggcgccgggctggccttctccctgatgaagtccctcggcgggggccgccggggcaccggggcgcagggcgagacgctgggggagaagtggaagcgccagctgaaccagctcagcaagtccgagttcaacatctacaagcggagcggcatcatggaggtcgaccgctccgaggccaaggaggggctgaagcggggcgagaccacccgccacgccgtgagccggggcaccgccaagctgcgctggttcgtggagcggaacctggtcaagcccgaggggaaggtgatcgacctcggctgcgggcgcggcgggtggtcctactactgcgcgggcctgaagaaggtgacggaggtcaagggctacaccaagggcgggcccgggcacgaggagcccatcccgatggccacctacggctggaacctggtgaagctccacagcgggaaggacgtgttcttcacgccgcccgagaagtgcgacacgctgctgtgcgacatcggcgagtccagccccaacccgaccatcgaggagggccggaccctccgcgtcctgaagatggtggagccctggctgcgggggaaccagttctgcatcaagatcctcaacccctacatgccctccgtggtcgagaccctggagcagatgcagcgcaagcacggcgggatgctggtgcggaacccgctcagccgcaactccacccacgagatgtactgggtgagctgcggcacgggcaacatcgtctccgccgtgaacatgaccagccggatgctgctgaaccgcttcaccatggcccaccgcaagcccacctacgagcgggacgtggacctcggggccggcacgcgccacgtcgcggtggagcccgaggtggccaacctggacatcatcgggcagcggatcgagaacatcaagcacgagcacaagtccacctggcactacgacgaggacaacccctacaagacctgggcctaccacggcagctacgaggtcaagccgtccgggagcgcctccagcatggtgaacggcgtcgtgaagctgctcaccaagccctgggacgtgatccccatggtcacgcagatcgccatgaccgacaccacccccttcggccagcagcgcgtgttcaaggagaaggtggacacgcggaccccgaaggcgaagcgcgggaccgcccagatcatggaggtcaccgcccggtggctgtggggcttcctgagccgcaacaagaagccccggatctgcacgcgcgaggagttcacccggaaggtgcgctccaacgccgccatcggggcggtgttcgtcgacgagaaccagtggaacagcgccaaggaggccgtggaggacgagcggttctgggacctcggccagaaggagcgcgagctgcacaagcaggggaagtgcgcgacctgcgtgtacaacatgatgggcaagcgggagaagaagctgggcgagttcgggaaggcgaagggctcccgcgccatctggtacatgtggctcggggcccggttcctggagttcgaggccctgggcttcatgaacgaggaccactggttcagccgcgagaactccctcagcggggtcgagggcgagggcctgcacaagctggggtacatcctccgggacatctccaagatccccggcgggaacatgtacgccgacgacaccgcgggctgggacacgcgcatcaccgaggacgacctgcagaacgaggccaagatcaccgacatcatggagccggagcacgccctgctcgccaccagcatcttcaagctgacgtaccagaacaaggtggtgcgggtccagcgccccgccaagaacggcaccgtgatggacgtgatctcccgccgggaccagcgcgggagcggccaggtcgggacctacggcctgaacaccttcacgaacatggaggcgcagctcatccggcagatggagtccgaggggatcttcctgcccagcgagctggagacccccaacctcgccgagcgcgtgctggactggctggagaagtacggcgtggagcggctcaagcgcatggccatctccggcgacgactgcgtcgtgaagccgatcgacgaccggttcgccaccgccctgaccgcgctgaacgacatggggaaggtgcgcaaggacatcccccagtgggagcccagcaagggctggaacgactggcagcaggtccccttctgctcccaccacttccaccagctcatcatgaaggacgggcgggagatcgtggtgccgtgccgcaaccaggacgagctggtcggccgggcccgcgtgagccagggggccggctggtccctgcgggagacggcctgcctcggcaagagctacgcccagatgtggcagctgatgtacttccaccgccgggacctgcgcctcgcggccaacgccatctgcagcgccgtgcccgtcgactgggtgcccacctcccggaccacctggagcatccacgcgcaccaccagtggatgacgaccgaggacatgctgtccgtgtggaaccgcgtctggatcgaggagaacccctggatggaggacaagacccacgtgagctcctggggcgacgtgccgtacctgggcaagcgggaggaccagtggtgcgggagcctcatcggcctgaccgcccgcgccacctgggcctccaacatccaggtcgccatcaaccaggtgcgccggctgatcgggaacgagaactacctcgactacatgacgagcatgaagcgcttcaagaacgagggcgaccccgagggcgcgctgtggtga

SEQ ID NO: 8644 - RNA, 9879 nt, synthetic construct
  misc_feature 1..9879: note = derived and/or modified CDS sequence (opt1) from DENV-1__JF937604__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagaccttcggcacggcctacggggtgctgttctccggcgtcagctggaccatgaagatcgggatcggcgtgctgctgacctggctcggcctgaactcccgcagcacctccctgagcatgacgtgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacgcgcctggagaacatcatgtggaagcagatctccaacgagctcaaccacatcctgctggagaacgacatgaagttcaccgtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcctggaacatctgggaggtcgaggactacggcttcgggatcttcaccaccaacatctggctgaagctgcgggacagctacacccaggtgtgcgaccaccgcctcatgtccgcggccatcaaggacagcaaggccgtgcacgccgacatgggctactggatcgagtccgagaagaacgagacgtggaagctggcccgggcgagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtcgtggacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgacgggcaccctggccgtgttcttcctgctcatcatggggcagctgacctggaacgacctgatccgcctctgcatcatggtcggcgccaacgcgagcgaccgcatggggatgggcaccacgtacctggccctgatggccaccttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgacggacttccagtcctaccagctctgggccaccctgctgagcctcaccttcatcaagaccacgttctccctgcactacgcctggaagaccatggccatggtcctgagcatcgtgtccctcttccccctgtgcctgagcaccacctcccagaagacgacctggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgacgatcctcctgaaggcgaccctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacacgatgtggcacgtgacccggggcgccgtcctcatgtaccaggggaagcgcctggagcccagctgggcgtccgtgaagaaggacctgatcagctacggcggcgggtggcggctccagggcttctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggacctccggcagccccatcgtgaaccgcgaggggaagatcgtgggcctgtacggcaacggggtcgtgaccacgtccggcacctacgtgagcgcgatcgcccaggccaaggccagccaggaggggccgctccccgagatcgaggacgaggtcttccggaagcgcaacctgaccatcatggacctgcaccccggctccgggaagacccggcgctacctcccggcgatcgtgcgggaggccatcaagcgcaagctgcgcacgctgatcctcgcccccacccgggtggtcgccagcgagatggccgaggcgctgaagggcatgcccatccgctaccagaccaccgccgtgaagtccgagcacacgggcaaggagatcgtggacctgatgtgccacgccaccttcaccatgcggctcctgagccccgtccgcgtgccgaactacaacatgatcatcatggacgaggcccacttcaccgacccctccagcatcgccgcgcgggggtacatctccacgcgcgtgggcatgggggaggccgccgccatcttcatgaccgccacgccgcccggcagcgtcgaggcgttcccgcagtccaacgccgtgatccaggacgaggagcgggacatccccgagcgcagctggaactccgggtacgagtggatcaccgacttccccggcaagacggtgtggttcgtccccagcatcaagtccggcaacgacatcgccaactgcctgcggaagaacgggaagcgcgtgatccagctcagccggaagaccttcgacaccgagtaccagaagaccaagaacaacgactgggactacgtggtcacgaccgacatctccgagatgggcgccaacttccgcgcggaccgggtgatcgacccgcgccggtgcctgaagcccgtgatcctgaaggacgggcccgagcgcgtcatcctcgccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgcgagaagtccgccgccatcgacggggagtaccggctgcgcggcgaggcgcggaagaccttcgtggagctcatgcgccgcggggacctgcccgtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctacgccgaccccctcgccctgcgggagttcaaggagttcgcggccggccgccggagcgtctccggggacctgatcctcgagatcggcaagctgccgcagcacctgacgcagcgcgcccagaacgccctcgacaacctggtgatgctgcacaacagcgagcagggcgggcgggcgtaccgccacgccatggaggagctccccgacaccatcgagaccctgatgctgctcgccctgatcgccgtgctgaccggcggggtcaccctcttcttcctgtccggccgggggctgggcaagacgagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagaccacgaagaaggacctggggatcggccacgtggccgtcgagaaccaccaccacgccgccatgctcgacgtggacctgcaccccgcctccgcgtggaccctgtacgccgtggccaccaccatcatcacgccgatgatgcgccacaccatcgagaacaccaccgccaacatcagcctcacggccatcgcgaaccaggccgccatcctgatggggctggacaagggctggcccatctccaagatggacatcggcgtccccctcctggccctggggtgctacagccaggtgaaccccctcaccctgaccgcggccgtgctgatgctcgtcgcccactacgccatcatcggcccggggctgcaggccaaggcgacccgcgaggcccagaagcggacggccgccggcatcatgaagaaccccaccgtggacgggatcgtggccatcgacctggaccccgtcgtgtacgacgcgaagttcgagaagcagctcggccagatcatgctgctgatcctctgcacctcccagatcctgctgatgcgcaccacgtgggccctctgcgagagcatcaccctggccaccggccccctgaccacgctctgggaggggtccccgggcaagttctggaacaccaccatcgccgtgagcatggccaacatcttccgggggtcctacctggcgggcgccggcctggccttcagcctcatgaagtccctcgggggcgggcgccgggggaccggggcccagggcgagacgctgggcgagaagtggaagcgccagctcaaccagctgagcaagagcgagttcaacacctacaagaagtccgggatcatggaggtcgaccggagcgaggcgaaggagggcctgaagcgcggggagaccaccaagcacgccgtgtcccggggcacggccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcgggcccggccacgaggagcccatcccgatggccacctacgggtggaacctcgtgaagctgcactccggcaaggacgtgttcttcatcccgcccgagaagtgcgacacgctgctctgcgacatcggggagagctcccccaacccgaccatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggacgggcaacatcgtcagcgcggtgaacatgacctcccggatgctgctcaaccgcttcaccatggcccaccgcaagcccacctacgagcgggacgtggacctgggggccggcacgcgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagccgagcggctccgccagctccatggtgaacggggtcgtgaagctcctgaccaagccctgggacgtgatccccatggtcacgcagatcgccatgaccgacaccacccccttcggccagcagcgcgtgttcaaggagaaggtggacacgcggaccccgaaggccaagcaggggaccgcccagatcatggaggtcaccgcgaagtggctgtggggcttcctcagccgcaacaagaagccccggatctgcacgcgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagccagatccccgggggcaacatgtacgccgacgacaccgccggctgggacacgcggatcaccgaggacgacctgcagaacgaggcccgcatcaccgacatcatggagccggagcacgcgctcctggccaagtccatcttcaagctgacctaccagaacaaggtggtccgggtgcagcgccccgccaagaacgggacggtgatggacgtcatcagccgccgggaccagcgcggctccggccaggtggggacctacggcctcaacaccttcaccaacatggaggcccagctgatccggcagatggagagcgaggggatcttctcccccagcgagctggagacgcccaacctcgccgagcgcgtgctggactggctggagaagtacggcgtcgagcggctcaagcgcatggcgatctccggggacgactgcgtggtgaagccgatcgacgaccggttcgccaccgccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggcgggctggtccctgcgggagaccgcctgcctcggcaagagctacgcccagatgtggcagctgatgtacttccaccgccgggacctgcgcctcgccgcgaacgccatctgcagcgccgtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgaccgcccgcgcgacctgggccaccaacatccaggtggccatcaaccaggtccgccggctgatcgggaacgagaactacctcgactacatgacgtccatgaagcgcttcaagaacgagagcgaccccgagggcgccctgtggtga

SEQ ID NO: 8645 - RNA, 9879 nt, synthetic construct
  misc_feature 1..9879: note = derived and/or modified CDS sequence (opt1) from DENV-1__JF937605__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgctgcaggagacctggaaccggcaggacctgctcgtgaccttcaagaccgcccacgccaagaagcaggaggtcgtggtgctgggctcccaggagggcgcgatgcacacggccctgaccggggccaccgagatccagaccagcggcacgaccaccatcttcgccgggcacctcaagtgccgcctgaagatggacaagctgaccctcaagggcatgtcctacgtcatgtgcacggggagcttcaagctggagaaggaggtggccgagacccagcacggcaccgtgctggtccagatcaagtacgagggcaccgacgcgccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtcgggaagctcgtgcaccagatcttcggcaccgcctacggggtgctgttcagcggcgtctcctggacgatgaagatcgggatcggcgtgctgctcacctggctgggcctgaacagccgctccaccagcctctccatgacctgcatcgccgtggggctggtcacgctgtacctcggcgtgatggtgcaggccgacagcgggtgcgtcatcaactggaagggccgggagctgaagtgcgggtccggcatcttcgtgaccaacgaggtgcacacctggaccgagcagtacaagttccaggccgacagcccgaagcgcctgagcgcggccatcggcaaggcctgggaggagggggtctgcggcatccggtccgccacccgcctcgagaacatcatgtggaagcagatcagcaacgagctgaaccacatcctgctcgagaacgacatgaagttcacggtggtggtcggggacgtggccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacgtgcatctggcccaagagccacaccctctggtccaacggcgtgctggagagcgagatgatcatccccaagatctacgggggcccgatctcccagcacaactaccgccccgggtacttcacccaggccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgtccgccggcagcggcgaggtcgacagcttctccctggggctgctctgcatcagcatcatgatcgaggaggtgatgcggtcccgctggagccggcgcatgctgatgaccggcaccctggccgtgttcttcctcctgatcatggggcagctgacgtggaacgacctcatccgcctgtgcatcatggtcggcgcgaacgcctccgaccggatggggatgggcaccacctacctggccctcatggccaccttcaagatgcgcccgatgttcgccgtgggcctgctgttccggcgcctcacgagccgggaggtgctgctgctcaccatcgggctgtccctggtcgcgagcgtggagctccccaactccctggaggagctgggcgacgggctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtgctgctcggctccctggggtgcaagccgctgacgatgttcctcatcgccgagaacaagatctggggccgccggagctggcccctgaacgaggggatcatggccgtcggcatcgtgtccatcctgctcagcagcctgctgaagaacgacgtgcccctcgccgggcccctgatcgccggcggcatgctgatcgcgtgctacgtcatctccgggagctccgccgacctcagcctggagaaggccgccaaggtgtcctgggaggaggaggccgagcacagcggcgcgtcccacaacatcctggtggaggtccaggacgacgggaccatgaagatcaaggacgaggagcgcgacgacaccctcaccatcctgctgaaggccaccctcctggccgtgagcggcgtgtacccgctgtccatccccgccaccctgttcgtctggtacttctggcagaagaagaagcagcggagcggggtgctgtgggacacccccagcccgcccgaggtggagcgcgccgtcctggacgacggcatctaccggatcatgcagcgcggcctgctcgggcggagccaggtgggcgtgggggtcttccaggagaacgtgttccacaccatgtggcacgtgacccgcggcgcggtcctgatgtaccaggggaagcggctggagccctcctgggccaacgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgtccgccatcgcccaggccaaggcgagccaggaggggccgctgcccgagatcgaggacgaggtcttccgcaagcggaacctgacgatcatggacctccaccccggcagcgggaagacccgccggtacctgccggccatcgtgcgcgaggccatcaagcgcaagctgcggaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgggagaagtccgccgcgatcgacggggagtaccgcctccggggcgaggcccgcaagaccttcgtggagctgatgcggcgcggggacctgcccgtgtggctctcctacaaggtcgccagcgagggcttccagtactccgaccggcgctggtgcttcgacggcgagcggaacaaccaggtgctggaggagaacatggacgtggagatctggacgaaggagggggagcgcaagaagctgcggccccgctggctcgacgcccggacctacagcgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatggggctcgacaagggctggcccatctccaagatggacatcggcgtccccctgctggccctcgggtgctacagccaggtgaaccccctgaccctgacggcggccgtgctcatgctggtcgcccactacgccatcatcggcccggggctgcaggccaaggcgacccgggaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacgtcccagatcctgctcatgcggaccacctgggccctgtgcgagagcatcaccctggccacgggccccctcaccaccctgtgggaggggtccccgggcaagttctggaacaccacgatcgccgtgagcatggccaacatcttccgcgggtcctacctggcgggcgccggcctcgccttcagcctgatgaagtccctcgggggcgggcggcgcgggaccggggcccagggcgagaccctcggcgagaagtggaagcggcagctgaaccagctgagcaagagcgagttcaacacctacaagcgctccgggatcatggaggtcgaccggagcgaggcgaaggagggcctcaagcgcggggagacgaccaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccgcatgctcctgaaccggttcacgatggcccaccgcaagcccacctacgagcgggacgtggacctgggggccggcacccgccacgtcgccgtggagcccgaggtggccaacctcgacatcatcggccagcggatcgagaacatcaagcacgagcacaagagcacctggcactacgacgaggacaacccctacaagacgtgggcgtaccacgggtcctacgaggtcaagccgagcggctccgccagctccatggtgaacggggtcgtgaagctgctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctctggggcttcctgagccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctccacaagcaggggaagtgcgccacgtgcgtctacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggcccgcatcacggacatcatggagccggagcacgcgctgctggccaagtccatcttcaagctcacctaccagaacaaggtggtccgggtgcagcgccccgccaagaacgggaccgtgatggacgtcatcagccggcgcgaccagcggggctccggccaggtggggacctacggcctgaacacgttcaccaacatggaggcccagctgatccgccagatggagagcgaggggatcttctcccccagcgagctcgagacccccaacctggccgagcgggtgctggactggctcgagaagtacggcgtcgagcgcctgaagcggatggcgatctccggggacgactgcgtggtgaagccgatcgacgaccgcttcgccaccgccctgacggccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggcgggctggtccctccgcgagaccgcctgcctgggcaagagctacgcccagatgtggcagctgatgtacttccaccggcgcgacctccggctggccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctcgggaagcgggaggaccagtggtgcggcagcctgatcggcctgacggcccgcgcgacctgggccaccaacatccaggtggccatcaaccaggtccggcgcctcatcgggaacgagaactacctggactacatgacctccatgaagcggttcaagaacgagagcgaccccgagggcgccctgtggtga

SEQ ID NO: 8646 - RNA, 9879 nt, synthetic construct
  misc_feature 1..9879: note = derived and/or modified CDS sequence (opt1) from DENV-1__JF937608__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagaaggtcgagacgtgggccctccggcaccccgggttcaccgtgatcgccctgttcctggcccacgcgatcggcaccagcatcacccagaaggggatcatcttcatcctcctgatgctggtgacgccctccatggccatgcgctgcgtcggcatcggcagccgggacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcgcaagctctgcatcgaggcgaagatctccaacaccacgaccgacagccggtgcccgacccagggcgaggccaccctggtggaggagcaggacgccaacttcgtgtgccgccggacgttcgtcgaccgcggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccggaccggcctcgacttcaacgagatggtgctgctgaccatgaaggagaagtcctggctcgtccacaagcagtggttcctggacctgcccctcccctggaccagcggggccagcacgtcccaggagacctggaaccgccaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccgcctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccgccggatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggccgacagcccgaagcggctgtccgcggccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtggaggactacggcttcgggatcttcacgaccaacatctggctgaagctgcgcgacagctacacccaggtctgcgaccaccggctcatgtccgcggccatcaaggacagcaaggccgtgcacgccgacatgggctactggatcgagtccgagaagaacgagacctggaagctggcccgcgcgagcttcatcgaggtgaagacgtgcatctggcccaagtcccacaccctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtggtcgacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcacgctggccgtgttcctgctcctgatcatggggcagctgacctggaacgacctcatccggctgtgcatcatggtgggcgccaacgcgagcgaccgcatggggatgggcaccacctacctggccctcatggccacgttcaagatgcgcccgatgttcgccgtcgggctgctgttccggcgcctcacctcccgggaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccgccggtcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgcgacgacaccctcaccatcctgctgaaggcgacgctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacgcgcggcgccgtgctgatgtaccaggggaagcggctggagcccagctgggcgtccgtcaagaaggacctcatcagctacggcggcgggtggcgcctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgggaggggaagatcgtgggcctctacggcaacggggtggtcaccacgagcggcacctacgtgagcgccatcgcgcaggccaaggcctcccaggaggggccgctgcccgagatcgaggacgaggtgttccgcaagcggaacctgaccatcatggacctccaccccggcagcgggaagacccgccggtacctgccggccatcgtccgcgaggcgatcaagcggaagctgcgcacgctcatcctggcccccacccgcgtggtggcctccgagatggccgaggccctgaagggcatgcccatccggtaccagaccaccgcggtcaagagcgagcacacgggcaaggagatcgtggacctcatgtgccacgccaccttcaccatgcgcctgctgtcccccgtgcgggtcccgaactacaacatgatcatcatggacgaggcccacttcaccgaccccagctccatcgccgcccgcgggtacatcagcacgcgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcaccgacttccccggcaagacggtgtggttcgtgccctccatcaagagcggcaacgacatcgccaactgcctccgcaagaacgggaagcgggtcatccagctgtcccgcaagaccttcgacaccgagtaccagaagaccaagaacaacgactgggactacgtggtgacgaccgacatcagcgagatgggcgccaacttccgggccgaccgcgtcatcgacccgcggcgctgcctgaagcccgtgatcctcaaggacgggcccgagcgggtgatcctggcgggccccatgccggtcaccgtggcctccgccgcccagcgccgggggcgcatcggccggaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccgcctccggggcgaggcccgcaagaccttcgtcgagctgatgcggcgcggggacctgcccgtgtggctctcctacaaggtggcgagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctactccgaccccctggccctgcgcgagttcaaggagttcgccgccggccggcgcagcgtgtccggggacctcatcctggagatcggcaagctgccgcagcacctcacgcagcgggcgcagaacgccctggacaacctggtcatgctccacaacagcgagcagggcgggcgcgcctaccggcacgccatggaggagctgcccgacaccatcgagaccctgatgctcctggcgctgatcgccgtgctcaccggcggggtgaccctgttcttcctgtccggccgcgggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcggcacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcgcacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcggaccacgtgggccctgtgcgagagcatcaccctggcgaccgggcccctcaccacgctgtgggagggctccccggggaagttctggaacaccaccatcgccgtgagcatggccaacatcttccgcggctcctacctggccggcgccgggctcgcgttcagcctgatgaagtccctgggcgggggccggcgcgggaccggcgcccagggcgagacgctcggggagaagtggaagcggcagctgaaccagctgtccaagagcgagttcaacacctacaagcgctccggcatcatggaggtggaccggagcgaggccaaggaggggctcaagcgcggcgagaccaccaagcacgccgtctcccgggggacggcgaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacccacgagatgtactgggtgtcctgcggcacggggaacatcgtgagcgccgtcaacatgacctcccggatgctcctgaaccgcttcaccatggcccaccgcaagcccacctacgagcgggacgtggacctgggcgcgggcacgcgccacgtggccgtcgagcccgaggtggccaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgcgtcttcaaggagaaggtggacacgcggaccccgaaggccaagcgcggcaccgcccagatcatggaggtgaccgccaagtggctctggggcttcctgtcccggaacaagaagccccgcatctgcacgcgggaggagttcacccgcaaggtccggagcaacgccgcgatcggggccgtgttcgtggacgagaaccagtggaactccgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgcggacgacaccgccgggtgggacacgcgcatcaccgaggacgacctccagaacgaggcccggatcaccgacatcatggagccggagcacgccctgctggccaagtccatcttcaagctcacctaccagaacaaggtggtgcgcgtccagcgccccgcgaagaacggcacggtgatggacgtgatcagccggcgcgaccagcgggggtccggccaggtcggcacctacgggctgaacaccttcaccaacatggaggcccagctgatccgccagatggagagcgagggcatcttctcccccagcgagctcgagacgcccaacctggccgagcgggtgctggactggctcgagaagtacggggtggagcgcctgaagcggatggccatctccggcgacgactgcgtcgtgaagccgatcgacgaccgcttcgccaccgcgctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgccgggtggagcctccgcgagaccgcctgcctgggcaagtcctacgcgcagatgtggcagctgatgtacttccaccggcgcgacctccggctggccgccaacgccatctgcagcgcggtgcccgtcgactggatccccacgtcccgcaccacctggagcatccacgcccaccaccagtggatgaccacggaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgaccgcccgcgccacctgggccaccaacatccaggtggcgatcaaccaggtgcggcgcctcatcggcaacgagaactacctggactacatgacgtccatgaagcggttcaagaacgagagcgaccccgagggggccctgtggtga

SEQ ID NO: 8647 - RNA, 9879 nt, synthetic construct
  misc_feature 1..9879: note = derived and/or modified CDS sequence (opt1) from DENV-1__GU131739__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccccgaccatcctcctgaaggcgacgctgctcgccgtctccggcgtgtaccccctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaacccgaagaacgtgcagaccgcccccgggaccttcaagacgcccgagggcgaggtgggcgccatcgccctggacttcaagcccgggaccagcggctccccgatcgtcaaccgcgaggggaagatcgtgggcctgtacggcaacggggtggtcaccaccagcggcacgtacgtgagcgcgatcgcccaggccaaggcctcccaggaggggcccctccccgagatcgaggacgaggtgttccggaagcgcaacctgaccatcatggacctgcacccgggcagcgggaagacccggcgctacctccccgcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtccccggtgcgcgtccccaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccccagagcaacgccgtcatccaggacgaggagcgggacatccccgagcgctcctggaacagcgggtacgagtggatcaccgacttccccggcaagaccgtgtggttcgtgccgtccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccccgccggtgcctgaagcccgtgatcctgaaggacgggcccgagcgcgtgatcctcgccggcccgatgcccgtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatcccggccctgttcgagcccgagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgacccgctcgccctgcgggagttcaaggagttcgccgcgggccgccggagcgtgtccggggacctgatcctcgagatcggcaagctgccccagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatcccggagcccgaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcacccggcctccgcctggacgctgtacgcggtggccaccaccatcatcacccccatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaacccgctcacgctgaccgccgcggtgctgatgctcgtggcccactacgccatcatcggccccgggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggcccgctgaccaccctctgggaggggtcccccggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagccgatccccatggccacctacgggtggaacctcgtcaagctgcactccggcaaggacgtgttcttcatcccgcccgagaagtgcgacaccctgctctgcgacatcggggagagctccccgaaccccacgatcgaggagggccgcaccctgcgggtgctgaagatggtcgagccctggctccgcgggaaccagttctgcatcaagatcctgaacccctacatgccgagcgtggtggagaccctggagcagatgcagcggaagcacggcggcatgctcgtccgcaaccccctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccgtacaagacctgggcctaccacgggtcctacgaggtgaagcccagcggctccgcgagcagcatggtcaacggggtggtcaagctcctgaccaagccctgggacgtgatccccatggtgacccagatcgccatgacggacaccaccccgttcggccagcagcgggtcttcaaggagaaggtggacacccgcacgcccaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagcccgagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagaccccgaacctcgccgagcgcgtgctggactggctggagaagtacggcgtggagcggctcaagcgcatggccatctccggggacgactgcgtcgtgaagcccatcgacgaccggttcgcgacggccctgaccgccctgaacgacatgggcaaggtgcgcaaggacatcccccagtgggagcccagcaaggggtggaacgactggcagcaggtcccgttctgctcccaccacttccaccagctcatcatgaaggacggccgggagatcgtggtgccctgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccgtggatggaggacaagacgcacatcagctcctggggcgacgtcccctacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8648 - RNA, 9879 nt, synthetic construct
  misc_feature 1..9879: note = derived and/or modified CDS sequence (opt1) from DENV-1__GU131740__SS-prME
  source 1..9879: mol_type = other RNA
agcgtgacgatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgtgccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccgctccaccagcctgtccatgacctgcatcgccgtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacgtggaacgacctgatccggctgtgcatcatggtgggcgccaacgcgtccgaccgcatggggatgggcaccacctacctcgccctgatggccaccttcaagatgcgcccgatgttcgccgtgggcctcctgttccggcgcctgacgagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccaccctcctgtccttcacgttcatcaagaccaccttcagcctgcactacgcctggaagaccatggccatggtgctctccatcgtgagcctgttccccctgtgcctctccacgaccagccagaagaccacctggctgcccgtcctgctcggctccctggggtgcaagccgctgacgatgttcctcatcgcggagaacaaggtgtggggccgcaagagctggcccctgaacgaggggatcatggccgtgggcatcgtcagcatcctgctctccagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgaccctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacaccatgtggcacgtgacccggggcgccgtgctgatgtaccaggggaagcgcctggagccctcctgggcgagcgtcaagaaggacctcatctcctacggcggcgggtggcggctgcagggcagctggaacacgggggaggaggtccaggtgatcgccgtcgagcccggcaagaaccccaagaacgtgcagaccgcccccgggaccttcaagacctccgagggcgaggtgggcgccatcgccctggacttcaagcccgggacgagcggcagccccatcgtcaaccgcgaggggaagatcgtgggcctctacggcaacggggtggtcaccacctccggcacctacgtgagcgcgatcgcccaggccaaggcctcccaggaggggcccctgccggagatcgaggacgaggtgttccggaagcgcaacctgacgatcatggacctccaccccggcagcgggaagacccggcgctacctgcccgcgatcgtccgggaggccatcaagcgcaagctgcggaccctcatcctggccccgacccgcgtggtggcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtgcgcgtccccaactacaacatgatcatcatggacgaggcccacttcaccgacccgagctccatcgccgcgcgggggtacatcagcacccgcgtgggcatgggggaggccgccgccatcttcatgaccgccacgccgcccggctccatggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccccgccggtgcctgaagccggtcatcctcaaggacgggcccgagcgcgtgatcctggccggccccatgcccgtcacggtggcctccgccgcccagcggcgcgggcggatcggccgcaaccacaacaaggagggcgaccagtacatctacatggggcagccgctgaacaacgacgaggaccacgcgcactggaccgaggccaagatgctcctggacaacatcaacacccccgagggcatcatccccgccctgttcgagcccgagcgggagaagtccgccgccatcgacggggagtaccgcctccgcggcgaggcgcggaagaccttcgtggagctgatgcgccgcggggacctgccggtctggctcagctacaaggtggcctccgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccccagcacctcacccagcgcgcccagaacgccctggacaacctggtgatgctccacaacagcgagcagggcgggcgggcctaccgccacgcgatggaggagctgccggacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagcccgaccgccagcggaccccgcaggacaaccagctcgcctacgtcgtgatcgggctgctgttcatgatcctcacggtggccgccaacgagatgggcctgctggagaccaccaagaaggacctcgggatcggccacgcggccgtcgagaaccaccaccacgccgccatgctggacgtggacctgcaccccgcctccgcgtggaccctctacgccgtggccacgaccatcatcacccccatgatgcgccacaccatcgagaacacgaccgccaacatcagcctgaccgccatcgcgaaccaggccgccatcctgatggggctcgacaagggctggccgatctccaagatggacatcggcgtccccctgctggccctcgggtgctacagccaggtgaaccccctgaccctgacggcggccgtgctcatgctggtcgcccactacgccatcatcggccccgggctgcaggccaaggcgacccgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgccgtgagcatggccaacatcttccgggggagctacctggcgggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagccggaggggaaggtgatcgacctcggctgcggccgcggcgggtggagctactactgcgccgggctgaagaaggtgaccgaggtcaaggggtacacgaagggcgggcccggccacgaggagcccatccccatggccacctacgggtggaacctggtgaagctgcactccggcaaggacgtgttcttcatcccgcccgagaagtgcgacaccctcctgtgcgacatcggggagagctcccccaaccccaccatcgaggagggccgcacgctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccggttcacgatggcccaccgcaagccgacctacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagcccgagcacgcgctgctggccaagtccatcttcaagctcacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgacggccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagaccgcctgcctgggcaagtcctacgcccagatgtggcagctgatgtacttccaccggcgcgacctccggctggccgcgaacgccatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgacggcccgggcgacctgggccaccaacatccaggtcgccatcaaccaggtgcgccgcctcatcggcaacgagaactacctggactacatgacctccatgaagcggttcaagaacgagagcgacccggagggggccctgtggtga

SEQ ID NO: 8649 - RNA, 9879 nt, synthetic construct
  misc_feature 1..9879: note = derived and/or modified CDS sequence (opt1) from DENV-1__GU131741__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggtgtccaccagccaggagacctggaaccggaaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctcgtgcagatcaagtacgagggcaccgacgcgccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtcttcacgtccgtggggaagctggtgcaccagatcttcggcaccgcctacggggtcctgttcagcggcgtgtcctggaccatgaagatcgggatcggcgtgctcctgacctggctgggcctcaacagccgctccacgagcctgtccatgacctgcatcgccgtcgggctggtgaccctctacctgggcgtgatggtccaggccgacagcgggtgcgtgatcaactggaagggccgggagctgaagtgcgggagcggcatcttcgtgaccaacgaggtccacacgtggaccgagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgccaacgcgtccgaccgcatggggatgggcacgacctacctcgccctgatggccaccttcaagatgcgcccgatgttcgccgtggggctcctgttccggcgcctgaccagccgggaggtcctgctcctgacgatcgggctgtccctcgtggccagcgtcgagctgcccaactccctggaggagctcggcgacgggctggcgatgggcatcatgatcctgaagctcctgaccgacttccagagccaccagctgtgggccaccctcctgtccctgaccttcatcaagacgaccttcagcctccactacgcctggaagaccatggccatggtgctgtccatcgtgagcctgttccccctctgcctgtccaccacgagccagaagaccacctggctgcccgtcctcctgggctccctggggtgcaagccgctcaccatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggacgatgaagatcaaggacgaggagcgggacgacaccctgaccatcctgctcaaggcgaccctgctggccgtgagcggcgtctacccgctctccatccccgccaccctgttcgtgtggtacttctggcagaagaagaagcagcgcagcggggtgctgtgggacacgcccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgccctcgacttcaagcccgggaccagcggcagccccatcgtgaaccgcgaggggaagatcgtcggcctgtacggcaacggggtggtgacgacctccggcacctacgtcagcgcgatcgcccaggccaaggcctcccaggaggggcccctgccggagatcgaggacgaggtgttccggaagcgcaacctcaccatcatggacctgcaccccggcagcgggaagacgcggcgctacctgcccgcgatcgtgcgggaggccatcaagcgcaagctccggaccctgatcctggccccgacccgcgtcgtggcctccgagatggccgaggcgctcaagggcatgcccatccgctaccagaccacggccgtcaagagcgagcacaccggcaaggagatcgtcgacctgatgtgccacgccaccttcaccatgcggctgctctcccccgtgcgcgtgcccaactacaacatgatcatcatggacgaggcccacttcacggacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctgcggaagaacgggaagcgcgtgatccagctgtcccggaagaccttcgacaccgagtaccagaagacgaagaacaacgactgggactacgtcgtgaccaccgacatcagcgagatgggcgccaacttccgcgcggaccgggtgatcgacccccgccggtgcctcaagccggtcatcctgaaggacgggcccgagcgcgtgatcctggccggccccatgcccgtcaccgtggcctccgccgcccagcggcgcgggcggatcggccgcaaccacaacaaggagggcgaccagtacatctacatggggcagccgctcaacaacgacgaggaccacgcgcactggacggaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagaccctcatgctgctggccctcatcgccgtcctgacgggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagcccgaccgccagcggaccccgcaggacaaccagctggcctacgtcgtgatcgggctcctcttcatgatcctgaccgtggccgccaacgagatgggcctgctcgagacgaccaagaaggacctggggatcggccacgtcgcggtggagaaccaccaccacgccgccatgctggacgtggacctccaccccgcctccgcctggaccctgtacgcggtcgccaccacgatcatcacccccatgatgcgccacaccatcgagaacaccacggccaacatcagcctgaccgccatcgccaaccaggcggccatcctcatggggctggacaagggctggccgatctccaagatggacatcggcgtgcccctgctcgccctggggtgctacagccaggtgaaccccctgaccctcaccgccgcggtcctgatgctggtggcccactacgccatcatcggccccgggctccaggccaaggccacgcgggaggcgcagaagcgcaccgccgccggcatcatgaagaacccgaccgtggacgggatcgtcgccatcgacctggaccccgtggtgtacgacgccaagttcgagaagcagctgggccagatcatgctcctgatcctgtgcacctcccagatcctcctgatgcgcacgacctgggcgctgtgcgagagcatcaccctcgccaccggccccctgacgaccctgtgggaggggtcccccggcaagttctggaacaccaccatcgccgtcagcatggccaacatcttccgggggagctacctcgccggcgcgggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgcggtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgccgtgaacatgacctcccgcatgctgctgaaccggttcaccatggcgcaccgcaagccgacgtacgagcgcgacgtcgacctcggggccggcacccggcacgtggccgtggagcccgaggtcgccaacctggacatcatcggccagcgcatcgagaacatcaagcacgagcacaagagcacctggcactacgacgaggacaacccctacaagacctgggcctaccacgggtcctacgaggtgaagcccagcggcagcgcgtccagcatggtcaacggggtggtgaagctgctcacgaagccgtgggacgtcatccccatggtgacccagatcgccatgaccgacaccacgcccttcggccagcagcgggtgttcaaggagaaggtcgacacccgcacccccaaggccaagcgggggaccgcccagatcatggaggtgacggccaagtggctgtggggcttcctgtcccgcaacaagaagccgcggatctgcacccgcgaggagttcacccggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgccctgctcgcgaagtccatcttcaagctgacgtaccagaacaaggtcgtgcgcgtgcagcggccggccaagaacgggaccgtcatggacgtgatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtcctcgactggctggagaagcacggggtggagcgcctgaagcggatggccatctccggcgacgactgcgtggtcaagcccatcgacgaccgcttcgcgaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgccgggtggagcctgcgcgagacggcgtgcctgggcaagtcctacgcccagatgtggcagctcatgtacttccaccggcgcgacctgcggctggccgccaacgcgatctgcagcgccgtgccggtggactgggtccccacctcccgcaccacctggagcatccacgcccaccaccagtggatgacgaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcaccgcccgggccacgtgggcgaccaacatccaggtggccatcaaccaggtgcgccgcctgatcggcaacgagaactacctggactacatgacctccatgaagcggttcaagaacgagagcgacccggagggggccctctggtga

SEQ ID NO: 8650 - RNA, 9879 nt, synthetic construct
  misc_feature 1..9879: note = derived and/or modified CDS sequence (opt1) from DENV-1__GU131743__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccgcatgctgctcaaccggttcacgatggcccaccgcaagcccacctacgagcgggacgtggacctgggggccggcacccgccacgtcgccgtggagcccgaggtggccaacctggacgtcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctcctgaccaagccctgggacgtcatccccatggtgacccagatcgccatgaccgacacgacccccttcggccagcagcgcgtgttcaaggagaaggtcgacacccggaccccgaaggccaagcgcgggacggcccagatcatggaggtgaccgcgaagtggctgtggggcttcctctcccggaacaagaagccccgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtcgtgcgggtgcagcgccccgccaagaacgggaccgtcatggacgtgatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtcctggactggctgggcaagtacggggtggagcgcctcaagcggatggcgatctccggcgacgactgcgtggtcaagccgatcgacgaccgcttcgccaccgccctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgcggggtggagcctgcgcgagaccgcctgcctcggcaagtcctacgcccagatgtggcagctgatgtacttccaccggcgcgacctgcggctcgccgcgaacgccatctgcagcgccgtgcccgtggactggatccccacctcccgcaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctgggcaagcgggaggaccagtggtgcggcagcctcatcgggctgacggcccgcgcgacctgggccaccaacatccaggtcgccatcaaccaggtgcggcgcctgatcggcaacgagaactacctcgactacatgacctccatgaagcggttcaagaacgagagcgaccccgagggggccctgtggtga

SEQ ID NO: 8651 - RNA, 9879 nt, synthetic construct
  misc_feature 1..9879: note = derived and/or modified CDS sequence (opt1) from DENV-1__JN093516__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccacgcgcggggcccgccggatggccatcctcggcgacaccgcgtgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgcgagctgaagtgcgggagcggcatcttcgtgaccaacgaggtgcacacctggaccgagcagtacaagttccaggccgactccccgaagcggctcagcgcggccatcggcaaggcctgggaggagggggtctgcggcatccgctccgccacccggctggagaacatcatgtggaagcagatcagcaacgagctgaaccacatcctcctggagaacgacatgaagttcacggtggtggtcggggacgtggccggcatcctggcgcaggggaagaagatgatccgcccccagcccatggagtacaagtactcctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctcaagctgcgcgactcctacacccaggtgtgcgaccaccggctgatgagcgcggccatcaaggactccaaggccgtgcacgccgacatgggctactggatcgagagcgagaagaacgagacctggaagctcgcccgcgcgtccttcatcgaggtcaagacgtgcatctggcccaagagccacaccctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcacgaccgtggtcgtggacgagcactgcggcaaccgcgggccgagcctgcggaccaccacggtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcacgctcgccgtgttcttcctgctgatcatggggcagctcacctggaacgacctgatccgcctgtgcatcatggtcggcgccaacgcgtccgaccggatggggatgggcaccacctacctcgccctgatggccacgttcaagatgcgcccgatgttcgccgtggggctcctgttccgccggctgaccagccgcgaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccacgctcctgtccctgaccttcatcaagaccaccttcagcctccactacgcctggaagacgatggccatggtcctgtccatcgtgagcctgttccccctctgcctgtccaccaccagccagaagaccacgtggctgcccgtgctcctgggctccctggggtgcaagccgctcaccatgttcctgatcgcggagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcctgctacgtcatctccgggagctccgcggacctgagcctggagaaggccgccgaggtgtcctgggaggaggaggccgagcacagcggcgcctcccacaacatcctcgtggaggtccaggacgacgggaccatgaagatcaaggacgaggagcgcgacgacaccctgaccatcctgctcaaggcgacgctgctggccgtgagcggcgtgtacccgctctccatccccgccaccctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacgcgcggcgccgtcctgatgtaccaggggaagcggctcgagccctcctgggcgagcgtgaagaaggacctgatctcctacggcggcgggtggcgcctgcagggcagctggaacaccggggaggaggtgcaggtcatcgccgtggagcccggcaagaaccccaagaacgtgcagaccgcccccgggaccttcaagacgtccgagggcgaggtcggcgccatcgccctcgacttcaagcccgggaccagcggcagccccatcgtgaaccgggaggggaagatcgtgggcctgtacggcaacggggtcgtgaccacctccggcacgtacgtgagcgcgatcgcccaggccaaggcctcccaggaggggcccctgccggagatcgaggacgaggtcttccgcaagcggaacctcaccatcatggacctgcaccccggcagcgggaagacccgccggtacctgcccgcgatcgtgcgcgaggccatcaagcggaagctccgcaccctgatcctggccccgacgcgggtggtcgcctccgagatggccgaggcgctcaagggcatgcccatccgctaccagaccaccgccgtcaagagcgagcacaccggcaaggagatcgtggacctgatgtgccacgccacgttcaccatgcgcctgctctcccccgtccgggtgcccaactacaacatgatcatcatggacgaggcccacttcaccgacccgagctccatcgccgcgcgcgggtacatcagcacccgggtgggcatgggggaggccgccgccatcttcatgacggccacgccgcccggctccgtcgaggcgttcccccagagcaacgccgtgatccaggacgaggagcgcgacatcccggagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgccaacttccgggcggaccgcgtgatcgacccccggcgctgcctcaagccggtgatcctgaaggacgggcccgagcgggtcatcctggccggccccatgcccgtgaccgtcgcctccgccgcccagcgccgggggcgcatcggccggaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgcgagaagtccgccgccatcgacggggagtaccggctgcgcggcgaggcgcgcaagacgttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgccgcgggccggcgcagcgtctccggggacctgatcctggagatcggcaagctcccccagcacctgacccagcgggcccagaacgccctggacaacctcgtgatgctgcacaacagcgagcagggcgggcgcgcctaccggcacgcgatggaggagctgccggacacgatcgagaccctcatgctgctggccctcatcgccgtgctgaccggcggggtcaccctgttcttcctctccggccgcgggctgggcaagaccagcatcggcctgctctgcgtgatggcctccagcgccctgctgtggatggcgtccgtggagccccactggatcgccgccagcatcatcctcgagttcttcctgatggtcctgctcatccccgagcccgaccggcagcgcacgccgcaggacaaccagctggcctacgtggtgatcgggctcctcttcatgatcctgaccgtcgccgcgaacgagatgggcctgctcgagaccaccaagaaggacctggggatcggccacgtggccgtggagaaccaccaccacgccacgatgctggacgtcgacctccaccccgcctccgcctggaccctgtacgcggtggccaccaccatcatcacgcccatgatgcggcacaccatcgagaacaccaccgccaacatcagcctgacggccatcgccaaccaggcggccatcctcatggggctggacaagggctggccgatctccaagatggacatcggcgtgcccctgctcgccctggggtgctacagccaggtcaaccccctgaccctcaccgccgcggtgctgatgctggtggcccactacgccatcatcggccccgggctccaggccaaggccacccgcgaggcgcagaagcggacggccgccggcatcatgaagaacccgaccgtcgacgggatcgtggccatcgacctggaccccgtggtctacgacgccaagttcgagaagcagctgggccagatcatgctcctgatcctgtgcacctcccagatcctcctgatgcgcaccacgtgggcgctgtgcgagagcatcaccctcgccaccggccccctgaccacgctgtgggaggggtcccccggcaagttctggaacaccaccatcgccgtgagcatggccaacatcttccgcgggagctacctcgccggcgcgggcctggccttctccctgatgaagtccctcgggggcgggcggcgcggcaccggggcccagggcgagacgctgggcgagaagtggaagcggcagctgaaccagctctccaagagcgagttcaacacctacaagcgctccgggatcatggaggtggaccggagcgaggccaaggagggcctgaagcgcggggagaccaccaagcacgcggtctcccggggcacggccaagctgcgctggttcgtggagcggaacctcgtgaagccggaggggaaggtcatcgacctgggctgcggccgcgggggctggagctactactgcgccgggctgaagaaggtgaccgaggtgaagggctacaccaagggcgggcccggccacgaggagcccatccccatggccacctacgggtggaacctggtcaagctccactccggcaaggacgtgttcttcatcccgcccgagaagtgcgacacgctgctgtgcgacatcggggagagctcccccaaccccaccatcgaggagggccggaccctccgcgtgctgaagatggtcgagccgtggctgcgggggaaccagttctgcatcaagatcctcaacccctacatgcccagcgtggtggagaccctggagcagatgcagcgcaagcacggcggcatgctggtccggaaccccctctcccgcaacagcacccacgagatgtactgggtgtcctgcgggacgggcaacatcgtgagcgccgtcaacatgacctcccggatgctgctgaaccgcttcaccatggcgcaccggaagccgacctacgagcgcgacgtggacctcggggccggcacgcgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtgaagcccagcggcagcgcgtccagcatggtcaacggggtggtcaagctgctcaccaagccgtgggacgtgatccccatggtgacgcagatcgccatgaccgacaccacccccttcggccagcagcgcgtcttcaaggagaaggtggacacgcggacccccaaggccaagcgcgggaccgcccagatcatggaggtgaccgccaagtggctgtggggcttcctgtcccggaacaagaagccgcgcatctgcacgcgggaggagttcacccgcaaggtccggagcaacgcggccatcggcgccgtgttcgtggacgagaaccagtggaactccgccaaggaggcggtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgccggctgggacacgcgcatcaccgaggacgacctgcagaacgaggccaagatcaccgacatcatggagcccgagcacgccctgctcgcgaagtccatcttcaagctgacctaccagaacaaggtggtgcgggtccagcgcccggccaagaacgggacggtgatggacgtgatcagccggcgcgaccagcgcggctccgggcaggtcggcacctacggcctgaacaccttcaccaacatggaggcccagctcatccggcagatggagagcgaggggatcttctcccccagcgagctggagacgcccaacctggccggccgcgtgctcgactggctggagaagcacggggtggagcggctgaagcgcatggccatctccggcgacgactgcgtcgtgaagcccatcgacgaccggttcgcgaccgccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcccgcgtgtcccagggcgccgggtggagcctgcgggagaccgcgtgcctgggcaagtcctacgcccagatgtggcagctcatgtacttccaccgccgggacctgcgcctggccgccaacgcgatctgcagcgccgtgccggtcgagtgggtgcccacgtcccggaccacctggagcatccacgcccaccaccagtggatgaccacggaggacatgctctccgtgtggaaccgcgtctggatcgaggagaacccctggatggaggacaagacccacatcagctcctggggcgacgtgccctacctgggcaagcgggaggaccagtggtgcggcagcctgatcgggctcaccgcccgcgccacctgggcgaccaacatccaggtggccatcaaccaggtccggcgcctgatcggcaacgagaactacctggactacatgacgtccatgaagcgcttcaagaacgagagcgacccggagggggccctctggtga

SEQ ID NO: 8652 - RNA, 9879 nt, synthetic construct
  misc_feature 1..9879: note = derived and/or modified CDS sequence (opt1) from DENV-1__GU131746__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagaaggcccagaacgccctggacaacctggtgatgctccacaacagcgagcagggcgggcgcgcctaccggcacgcgatggaggagctgcccgacacgatcgagaccctgatgctcctggccctgatcgccgtcctcaccggcggggtgaccctgttcttcctgtccggccgcgggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcggcacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcgcaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcggaccacctgggcgctgtgcgagagcatcacgctggccaccggccccctcaccaccctgtgggaggggtccccgggcaagttctggaacacgaccatcgccgtcagcatggccaacatcttccgcgggtcctacctggccggcgcgggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggccaaggagggcctcaagcgcggggagaccaccaagcacgcggtgtcccggggcaccgccaagctgcgctggttcgtcgagcggaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccggaccctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgccgtgaacatgacgtcccggatgctcctgaaccgcttcaccatggcgcaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccgcccagatcatggaggtgaccgccaagtggctctggggcttcctgtcccggaacaagaagccccgcatctgcacccgggaggagttcacgcgcaaggtgcggagcaacgcggccatcggcgccgtcttcgtggacgagaaccagtggaactccgccaaggaggcggtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcacggaggacgacctccagaacgaggcccggatcaccgacatcatggagccggagcacgccctgctggcgaagtccatcttcaagctcacctaccagaacaaggtcgtgcgcgtgcagcgccccgccaagaacgggaccgtcatggacgtgatcagccggcgcgaccagcggggctccggccaggtggggacgtacggcctgaacaccttcaccaacatggaggcccagctgatccgccagatggagagcgaggggatcttctcccccagcgagctcgagacccccaacctggccgagcgggtcctggactggctcgagaagtacggcgtggagcgcctgaagcggatggccatctccggggacgactgcgtggtcaagccgatcgacgaccgcttcgcgacggccctgaccgccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggccggctggagcctccgcgagaccgcgtgcctggggaagtcctacgcccagatgtggcagctgatgtacttccaccggcgcgacctccggctggccgccaacgcgatctgcagcgccgtgcccgtggactggatccccacctcccgcacgacctggagcatccacgcccaccaccagtggatgaccaccgaggacatgctgtccgtctggaaccgggtgtggatcgaggagaacccctggatggaggacaagacgcacatcagctcctggggcgacgtgccgtacctcgggaagcgcgaggaccagtggtgcggcagcctgatcggcctgaccgcccgcgccacctgggcgaccaacatccaggtcgccatcaaccaggtgcggcgcctcatcgggaacgagaactacctggactacatgacctccatgaagcggttcaagaacgagagcgaccccgagggcgccctgtggtga

SEQ ID NO: 8653 - RNA, 9879 nt, synthetic construct
  misc_feature 1..9879: note = derived and/or modified CDS sequence (opt1) from DENV-1__JF937609__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcacgctcatcctggcccccacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctcaaggacgggcccgagcgcgtgatcctggcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtcatgctccacaacagcgagcagggcgggcgggcctaccgccacgccatggaggagctgcccgacaccatcgagaccctgatgctcctggcgctgatcgccgtgctcaccggcggggtgaccctgttcttcctgtccggccgggggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcggacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcacggggaacatcgtgagcgccgtcaacatgacctcccgcatgctcctgaaccgcttcaccatggcccaccggaagcccacctacgagcgcgacgtggacctgggcgcgggcacgcggcacgtggccgtcgagcccgaggtggccaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgggtcttcaaggagaaggtggacacgcgcaccccgaaggccaagcggggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggcccgctccatcttcaagctcacctaccagaacaaggtggtgcgggtccagcgccccgcgaagaacggcacggtgatggacgtgatcagccggcgcgaccagcgggggtccggccaggtcggcacctacgggctgaacaccttcaccaacatggaggcccagctgatccgccagatggagagcgagggcatcttctcccccagcgagctcgagacgcccaacctggccgagcgggtgctggactggctcgagaagtacggggtggagcgcctgaagcggatggccatctccggcgacgactgcgtcgtgaagccgatcgacgaccgcttcgccaccgcgctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgccgggtggagcctccgcgagaccgcctgcctgggcaagtcctacgcgcagatgtggcagctgatgtacttccaccggcgcgacctccggctggccgccaacgccatctgcagcgcggtgcccgtcgactggatccccacgtcccgcaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgggaggaccagtggtgcggcagcctgatcgggctgaccgcccgcgccacctgggccaccaacatccaggtggcgatcaaccaggtgcggcgcctcatcggcaacgagaactacctggactacatgacgtccatgaagcggttcaagaacgagagcgaccccgagggggccctgtggtga

SEQ ID NO: 8654 - RNA, 9879 nt, synthetic construct
  misc_feature 1..9879: note = derived and/or modified CDS sequence (opt1) from DENV-1__KF921949__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttccgcaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtgaccggcatcctcgcccaggggaagaagatgatccgcccccagcccatggagtacaagtacagctggaagtcctggggcaaggcgaagatcatcggcgccgacgtgcagaacaccaccttcatcatcgacgggcccaacacgccggagtgccccgacgaccagcgggcctggaacatctgggaggtcgaggactacggcttcgggatcttcaccaccaacatctggctgaagctgcgcgacagctacacccaggtgtgcgaccaccggctcatgtccgccgcgatcaaggacagcaaggccgtgcacgccgacatgggctactggatcgagtccgagaagaacgagacgtggaagctggcccgcgccagcttcatcgaggtcaagacctgcatctggcccaagtcccacaccctgtggagcaacggcgtgctcgagtccgagatgatcatccccaagatctacgggggcccgatcagccagcacaactaccggcccgggtacttcacccagacggcgggcccctggcacctggggaagctggagctcgacttcgacctgtgcgagggcaccaccgtggtcgtggacgagcactgcggcaaccgcgggccgtccctgcggaccacgaccgtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgacgggcaccctggccgtgttcctgctcctgatcatggggcagctgacctggaacgacctcatccgcctgtgcatcatggtcggcgccaacgccagcgaccggatggggatgggcaccacgtacctggcgctcatggccaccttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacgggctcgccatgggcatcatgatcctgaagctgctcacggacttccagtcccaccagctgtgggcgaccctgctcagcctgaccttcatcaagaccacgttctccctgcactacgcctggaagaccatggccatggtcctcagcatcgtgtccctgttccccctgtgcctcagcaccacctcccagaagacgacctggctgcccgtgctgctcggcagcctggggtgcaagccgctgaccatgttcctcatcgccgagaacaagatctggggccgccggtcctggcccctgaacgaggggatcatggcggtcggcatcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggaccatgaagatcaaggacgaggagcgcgacgacaccctcacgatcctgctgaaggccaccctcctggcggtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacacgatgtggcacgtgacccgcggcgccgtcctgatgtaccaggggaagcggctggagcccagctgggcctccgtgaagaaggacctcatcagctacggcggcgggtggcgcctgcagggctcctggaacaccggggaggaggtgcaggtcatcgcggtggagcccggcaagaaccccaagaacgtgcagaccgcccccgggacgttcaagacccccgagggcgaggtcggcgccatcgccctggacttcaagcccgggaccagcggctcccccatcgtgaaccgggaggggaagatcgtgggcctctacggcaacggggtcgtgaccacgagcggcacctacgtgagcgccatcgcgcaggccaaggcctcccaggaggggccgctgcccgagatcgaggacgaggtcttccgcaagcggaacctgaccatcatggacctccaccccggcagcgggaagacccgccggtacctgccggccatcgtgcgcgaggcgatcaagcgcaagctgcggacgctcatcctggcccccacccgcgtggtcgcctccgagatggccgaggccctgaagggcatgcccatccggtaccagaccaccgcggtcaagagcgagcacacgggcaaggagatcgtggacctcatgtgccacgccaccttcaccatgcgcctgctgtcccccgtccgggtgccgaactacaacatgatcatcatggacgaggcccacttcaccgaccccagctccatcgccgcccgcgggtacatcagcacgcgggtgggcatgggggaggcggccgccatcttcatgaccgccacgccgcccggctccgtcgaggccttcccgcagagcaacgcggtgatccaggacgaggagcgcgacatccccgagcggtcctggaacagcgggtacgagtggatcaccgacttccccggcaagacggtgtggttcgtcccctccatcaagagcggcaacgacatcgccaactgcctccgcaagaacgggaagcgggtgatccagctgtcccgcaagaccttcgacaccgagtaccagaagaccaagaacaacgactgggactacgtggtcacgaccgacatcagcgagatgggcgccaacttccgggccgaccgcgtgatcgacccgcggcgctgcctgaagcccgtgatcctcaaggacgggcccgagcgggtcatcctggcgggccccatgccggtgaccgtcgcctccgccgcccagcgccgggggcgcatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgggagaagtccgccgccatcgacggggagtaccgcctccggggcgaggcccgcaagaccttcgtggagctgatgcggcgcggggacctgcccgtgtggctctcctacaaggtcgcgagcgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacctactccgaccccctggccctgcgcgagttcaaggagttcgccgccggccggcgcagcgtctccggggacctcatcctggagatcggcaagctgccgcagcacctcacgcagcgggcgcagaacgccctggacaacctggtgatgctccacaacagcgagcagggcgggcgcgcctaccggcacgccatggaggagctgcccgacaccatcgagaccctgatgctcctggcgctgatcgccgtgctcaccggcggggtcaccctgttcttcctgtccggccgcgggctcggcaagacgagcatcggcctgctgtgcgtgatggcctccagcgtgctcctgtggatggcctccgtcgagccccactggatcgccgcgagcatcatcctggagttcttcctcatggtgctgctgatccccgagccggaccggcagcgcacgccccaggacaaccagctcgcctacgtggtcatcgggctgctgttcatgatcctcaccgtggccgccaacgagatgggcctgctggagaccacgaagaaggacctcgggatcggccacgtggccgtcgagaaccaccaccacgcggccatgctggacgtggacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatggggctcgacaagggctggcccatctccaagatggacatcggcgtccccctgctggccctcgggtgctacagccaggtgaaccccctgaccctgaccgccgccgtgctcatgctggtcgcgcactacgccatcatcggcccggggctgcaggccaaggccacccgggaggcccagaagcgcacggcggccggcatcatgaagaaccccaccgtggacgggatcgtggccatcgacctcgaccccgtcgtgtacgacgccaagttcgagaagcagctgggccagatcatgctgctcatcctgtgcacctcccagatcctgctcatgcggaccacgtgggccctgtgcgagagcatcaccctggcgaccggccccctcaccacgctgtgggaggggtccccgggcaagttctggaacaccaccatcgccgtgagcatggccaacatcttccgcgggtcctacctggccggcgccggcctcgcgttcagcctgatgaagtccctcgggggcgggcggcgcgggaccggggcccagggcgagacgctcggcgagaagtggaagcggcagctgaaccagctgtccaagagcgagttcaacacctacaagcgctccgggatcatggaggtcgaccggagcgaggccaaggagggcctcaagcgcggggagaccaccaagcacgccgtgtcccggggcacggcgaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacctacgggtggaacctggtgaagctgcactccggcaaggacgtgttcttcatcccgcccgagaagtgcgacacgctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggacgggcaacatcgtcagcgccgtgaacatgacctcccgcatgctcctgaaccggttcaccatggcccaccgcaagcccacctacgagcgggacgtggacctgggggcgggcacgcgccacgtcgccgtggagcccgaggtggccaacctcgacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacgcagatcgcgatgaccgacaccacccccttcggccagcagcgcgtgttcaaggagaaggtggacacgcggaccccgaaggccaagcgcgggaccgcccagatcatggaggtcaccgccaagtggctctggggcttcctgtcccggaacaagaagccccgcatctgcacgcgggaggagttcaccaagaaggtgcgcagcaacgccgcgatcggcgccgtgttcgtcgacgagaaccagtggaactccgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgcggacgacaccgccggctgggacacgcggatcaccgaggacgacctccagaacgaggcccgcatcaccgacatcatggagccggagcacgccctgctggccaagtccatcttcaagctcacctaccagaacaaggtggtccgcgtgcagcggcccgcgaagaacgggacggtgatggacgtcatcagccgccgggaccagcgcggctccggccaggtgggcacctacggcctgaacaccttcaccaacatggaggcccagctgatccggcagatggagagcgaggggatcttctcccccagcgagctcgagacgcccaacctggccgagcgcgtgctggactggctcgagaagtacggcgtcgagcggctgaagcgcatggccatctccggggacgactgcgtggtgaagccgatcgacgaccggttcgccaccgcgctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcctgcctggggaagtcctacgcgcagatgtggcagctgatgtacttccaccgccgggacctccgcctggccgccaacgccatctgcagcgcggtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctcgggaagcgcgaggaccagtggtgcggcagcctgatcggcctgaccgcccgggccacctgggccaccaacatccaggtggcgatcaaccaggtccgccggctcatcgggaacgagaactacctggactacatgacgtccatgaagcgcttcaagaacgagagcgaccccgagggcgccctgtggtga

SEQ ID NO: 8655 - RNA, 9879 nt, synthetic construct
  misc_feature 1..9879: note = derived and/or modified CDS sequence (opt1) from DENV-1__GU131747__SS-prME
  source 1..9879: mol_type = other RNA
agcgtgaccatgctgctgatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgccgggaagctcgtgcaccagatcttcggcaccgcctacggggtcctgttctccggcgtgagctggacgatgaagatcgggatcggcgtgctgctcacctggctgggcctgaactcccgcagcacctccctcagcatgacctgcatcgccgtcgggctggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggacagctacacccaggtgtgcgaccaccgcctgatgtccgccgccatcaaggacagccgggccgtccacgccgacatgggctactggatcgagtccgagaagaacgagacctggaagctggcgcgcgccagcttcatcgaggtgaagacgtgcatctggcccaagtcccacaccctctggagcaacggcgtgctggagtccgagatgatcatccccaagatctacgggggcccgatcagccagcacaactaccggcccgggtacttcacccagaccgccggcccctggcacctggggaagctcgagctggacttcgacctgtgcgagggcacgaccgtcgtggtggacgagcactgcggcaaccgcgggccgtccctccggaccaccacggtcaccggcaagatcatccacgagtggtgctgccgcagctgcaccctgccgcccctgcggttccgcggggaggacggctgctggtacgggatggagatccggcccgtgaaggagaaggaggagaacctcgtgaagtccatggtcagcgccggcagcggcgaggtggactccttcagcctggggctgctctgcatctccatcatgatcgaggaggtgatgcgcagccggtggtcccgcaagatgctgatgaccggcacgctggccgtcttcttcctcctgatcatggggcagctgacctggaacgacctcatccgcctgtgcatcatggtgggcgcgaacgccagcgaccggatggggatgggcaccacctacctggccctcatggccacgttcaagatgcgcccgatgttcgccgtgggcctgctgttccggcgcctcacctcccgggaggtcctgctgctcaccatcgggctgagcctggtggcgtccgtggagctccccaacagcctggaggagctgggcgacgggctcgccatgggcatcatgatcctgaagctgctcaccgacttccagtcccaccagctgtgggccacgctgctcagcctgaccttcatcaagaccaccttctccctgcactacgcctggaagacgatggcgatggtcctcagcatcgtgtccctgttccccctgtgcctcagcaccacctcccagaagaccacgtggctgcccgtcttcctgggcagcctcgggtgcaagccgctgaccatgttcctgatcgccgagaacaagatctggggccgccggtcctggcccctcaacgaggggatcatggccgtgggcatcgtgagcatcctgctgagctccctcctgaagaacgacgtccccctggccgggcccctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggaccatgaagatcaaggacgaggagcgcgacgacaccctgaccgtgctcctgaaggccacgctgctcgccgtctccggcgtgtacccgctgagcatccccgccaccctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacgcgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctccccgagatcgaggacgaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtggtggcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgcgaacttccgggccgaccgcgtcatcgacccgcggcgctgcctgaagcccgtgatcctgaaggacgggcccgagcgggtgatcctcgccggccccatgccggtcaccgtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgccgcgaacgagatgggcctcctggagaccaccaagaaggacctggggatcggccacgtggccgtggagaaccaccaccacgccgccatgctcgacgtcgacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtcaaccccctcacgctgaccgcggccgtgctgatgctcgtggcccactacgccatcatcggcccggggctgcaggccaaggcgacccgggaggcccagaagcgcaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggcgaaggagggcctgaagcgcggggagaccaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacgtcccgcatgctgctcaaccggttcaccatggcccaccgcaagcccacctacgagcgggacgtggacctgggggccggcacccgccacgtggccgtcgagcccgaggtggccaacctggacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctcctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgaagtggctgtggggcttcctctcccggaacaagaagccccgcatctgcacccgggaggagttcacgcgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgcgctcctggccaagtccatcttcaagctgacctaccagaacaaggtggtgcgggtccagcgccccgccaagaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagcacggcgtggagcgcctcaagcggatggcgatctccggggacgactgcgtcgtgaagccgatcgacgaccgcttcgccacggccctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtcgactggatccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgggaggaccagtggtgcggcagcctcatcggcctgaccgcccgcgcgacctgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8656 - RNA, 9879 nt, synthetic construct
  misc_feature 1..9879: note = derived and/or modified CDS sequence (opt1) from DENV-1__GU131748__SS-prME
  source 1..9879: mol_type = other RNA
agcgtgaccatgctgttcatgctcgtgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctggcgccccacgtcggcctcgggctggagacccgcaccgagacctggatgagctccgagggcgcctggaagcagatccagcgggtggagacgtgggccctgcggcaccccgggttcaccgtgatcgccctcttcctggcccacgcgatcggcaccagcatcacccagaaggggatcatcttcatcctgctcatgctggtcacgccctccatggccatgcggtgcgtgggcatcggcagccgcgacttcgtggaggggctgtccggcgccacctgggtcgacgtggtgctcgagcacgggagctgcgtcaccaccatggccaaggacaagcccacgctggacatcgagctgctcaagaccgaggtgaccaaccccgccgtgctgcggaagctgtgcatcgaggcgaagatctccaacaccacgaccgacagccgctgcccgacccagggcgaggccaccctcgtcgaggagcaggacgccaacttcgtgtgccggcgcacgttcgtggaccggggctgggggaacggctgcgggctgttcggcaaggggtccctgatcacgtgcgccaagttcaagtgcgtcaccaagctcgagggcaagatcgtgcagtacgagaacctgaagtacagcgtgatcgtcaccgtgcacacgggcgaccagcaccaggtcgggaacgagtccaccgagcacggcaccaccgccaccatcacgccccaggcgcccaccaccgagatccagctgaccgactacggggccctcacgctggactgcagcccccgcaccggcctggacttcaacgagatggtgctcctgaccatgaaggagaagtcctggctggtgcacaagcagtggttcctcgacctgcccctgccctggaccagcggggccagcacgtcccaggagacctggaaccggcaggacctcctggtcaccttcaagaccgcccacgccaagaagcaggaggtggtggtcctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtgatgtgcacggggtccttcaagctggagaaggaggtggccgagacccagcacggcaccgtcctcgtgcagatcaagtacgagggcaccgacgcgccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtcttcaccagcgtggggaagctggtgcaccagatcttcggcaccgcctacggggtcctgttctccggcgtgagctggacgatgaagatcgggatcggcgtgctcctgacctggctgggcctcaactcccgcagcacctccctgagcatgacctgcatcgccgtcgggctggtgacgctctacctgggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtggtcgtgggggacgtggccggcatcctggcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtcgtggtggacgagcactgcggcaaccgggggccgtccctgcgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcacgctcgccgtcttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtgggcctcctgttccgccggctgacctcccgcgaggtcctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtgctgagcatcgtgtccctgttccccctctgcctgagcaccacctcccagaagaccacgtggctgcccgtcctcctgggcagcctggggtgcaagccgctcaccatgttcctgatcgcggagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgacgctgctggccgtgtccggcgtctacccgctcagcatccccgccaccctgttcgtgtggcacttctggcagaagaagaagcagcgctccggggtgctgtgggacacccccagcccgcccgaggtcgagcgggccgtgctcgacgacggcatctaccgcatcatgcagcggggcctgctggggcgctcccaggtgggcgtcggggtgttccaggagaacgtgttccacaccatgtggcacgtcacgcggggcgccgtgctgatgtaccaggggaagcgcctcgagcccagctgggcgtccgtgaagaaggacctgatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtgcgggaggccatcaagcgcaagctccgcaccctgatcctggcccccacgcgggtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctcaagcccgtcatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgcgaggcgcagaagcggaccgccgccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtcagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtgtcccgcggcaccgccaagctgcggtggttcgtcgagcgcaacctcgtgaagcccgaggggaaggtgatcgacctgggctgcggccgcggcgggtggagctactactgcgccgggctgaagaaggtcacggaggtgaaggggtacaccaagggcggccccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccgcaccctccgggtgctgaagatggtggagccctggctgcgcgggaaccagttctgcatcaagatcctcaacccctacatgcccagcgtcgtggagaccctggagcagatgcagcggaagcacggcggcatgctggtgcgcaacccgctctcccggaacagcacccacgagatgtactgggtctcctgcgggaccggcaacatcgtgagcgccgtgaacatgacgtcccgcatgctgctgaaccgcttcaccatggcgcaccggaagcccacctacgagcgcgacgtcgacctcggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctcaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctcatccggcagatggagagcgaggggatcttctcccccagcgagctggagacccccaacctggccgagcgcgtcctcgactggctggagaagtacggcgtgaagcggctgaagcgcatggccatctccggggacgactgcgtggtcaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctggggaagcgcgaggaccagtggtgcggcagcctgatcggcctcaccgcccgggccacctgggcgaccaacatccaggtcgccatcaaccaggtgcgccggctgatcgggaacgagaactacctggactacatgacctccatgaagcgcttcaagaacgagagcgaccccgagggcgccctctggtga

SEQ ID NO: 8657 - RNA, 9879 nt, synthetic construct
  misc_feature 1..9879: note = derived and/or modified CDS sequence (opt1) from DENV-1__GQ868615__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtggagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8658 - RNA, 9879 nt, synthetic construct
  misc_feature 1..9879: note = derived and/or modified CDS sequence (opt1) from DENV-1__GU131749__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctaccgcgtgctgttctccggggtcagctggaccatgaagatcggcatcggggtgctgctcacgtggctgggcctgaactcccggagcacctccctcagcatgacctgcatcgccgtgggcctggtcaccctgtacctcggggtgatggtgcaggccgactccggctgcgtcatcaactggaaggggcgcgagctgaagtgcggcagcgggatcttcgtgacgaacgaggtgcacacctggaccgagcagtacaagttccaggcggacagcccgaagcggctgtccgccgccatcggcaaggcctgggaggagggcgtctgcgggatccgcagcgccacccggctcgagaacatcatgtggaagcagatctccaacgagctgaaccacatcctgctcgagaacgacatgaagttcaccgtggtggtcggcgacgtggcggggatcctggtgcagggcaagaagatgatccgcccccagcccatggagtacaagtacagctggaagtcctgggggaaggccaagatcatcggcgccgacgtccagaacagcacgttcatcatcgacggccccaacaccccggagtgccccgacgaccagcgggcctggaacatctgggaggtggaggactacgggttcggcatcttcaccaccaacatctggctgaagctccgcgactcctacacccaggtgtgcgaccaccggctgatgagcgcggccatcaaggactccaaggccgtccacgccgacatggggtactggatcgagagcgagaagaacgagacctggaagctggcccgcgcgtccttcatcgaggtgaagacctgcatctggcccaagagccacaccctctggtccaacggcgtgctggagagcgagatgatcatccccaagatccacggcgggccgatctcccagcacaactaccggcccggctacttcacgcagaccgccgggccctggcacctgggcaagctcgagctggacttcgacctgtgcgaggggaccaccgtcgtggtggacgagcactgcggcaaccgcggcccgagcctccggacgaccaccgtcaccgggaagatcatccacgagtggtgctgccgctcctgcacgctgccgcccctgcggttccgcggcgaggacgggtgctggtacggcatggagatccggcccgtgaaggagaaggaggagaacctcgtgaagtccatggtcagcgccgggtccggcgaggtggacagcttctccctgggcctgctctgcatcagcatcatgatcgaggaggtgatgcgctcccggtggagccgcaagatgctgatgaccgggaccctggccgtcttcttcctcctgatcatgggccagctgacctggaacgacctcatccgcctgtgcatcatggtgggggccaacgcgtccgaccggatgggcatggggacgacctacctggccctcatggccaccttcaagatgcgcccgatgttcgccgtgggcctgctgttccggcgcctcaccagccgggaggtcctgctgctcacgatcggcctgtccctggtggccagcgtcgagctccccaactccctggaggagctgggggacggcctcgcgatggggatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcggctccctgggctgcaagccgctgaccatgttcctcatcgcggagaacaagatctgggggcgcaagagctggcccctgaacgagggcatcatggccgtggggatcgtgagcatcctgctctccagcctgctgaagaacgacgtccccctcgccggccccctgatcgccgggggcatgctgatcgcctgctacgtgatctccggcagctccgcggacctcagcctggagaaggccgccgaggtgtcctgggaggaggaggccgagcacagcggggcctcccacaacatcctggtcgaggtgcaggacgacggcacgatgaagatcaaggacgaggagcgggacgacaccctcaccatcctgctgaaggcgaccctcctggccgtgagcggggtctacccgctgtccatccccgccaccctcttcgtgtggcacttctggcagaagaagaagcagcgcagcggcgtgctgtgggacacgcccagcccgcccgaggtcgagcgggccgtgctggacgacgggatctaccgcatcatgcagcggggcctgctcggccgcagccaggtgggggtcggcgtgttccaggagaacgtgttccacaccatgtggcacgtcacccgcggggccgtgctgatgtaccagggcaagcgcctggagccctcctgggcgagcgtgaagaaggacctcatctcctacgggggcggctggcggttccaggggagctggaacaccggcgaggaggtccaggtgatcgccgtggagcccgggaagaaccccaagaacgtccagacggcccccggcaccttcaagacccccgagggggaggtgggcgccatcgccctggacttcaagcccggcacctccgggagccccatcgtgaaccgcgagggcaagatcgtcgggctgtacggcaacggcgtggtgacgaccagcgggacctacgtctccgcgatcgcccaggccaaggccagccaggagggcccgctccccgagatcgaggacgaggtgttccggaagcgcaacctgaccatcatggacctgcaccccgggtccggcaagacgcggcgctacctcccggcgatcgtgcgggaggccatcaagcgcaagctgcgcaccctgatcctcgcccccacccgggtcgtggccagcgagatggccgaggcgctgaaggggatgcccatccgctaccagaccacggccgtgaagtccgagcacaccggcaaggagatcgtcgacctgatgtgccacgccaccttcaccatgcggctcctgagccccgtgcgcgtgccgaactacaacatgatcatcatggacgaggcccacttcacggacccctccagcatcgccgcgcggggctacatctccacccgcgtcgggatgggcgaggccgccgccatcttcatgaccgccacgccgcccgggagcatggaggcgttcccgcagtccaacgccgtgatccaggacgaggagcgggacatccccgagcgcagctggaactccggctacgagtggatcacggacttccccgggaagaccgtgtggttcgtccccagcatcaaggccggcaacgacatcgccaactgcctgcggaagaacggcaagcgcgtgatccagctctcccggaagaccttcgacaccgagtaccagaagacgaagaacaacgactgggactacgtggtcaccaccgacatcagcgagatgggggcgaacttccgcgccgaccgggtgatcgacccgcgccggtgcctgaagcccgtgatcctgaaggacggccccgagcgcgtcatcctcgccgggcccatgccggtgaccgtcgcctccgccgcgcagcggcgcggccggatcgggcgcaaccacaacaaggagggcgaccagtacatctacatgggccagcccctgaacaacgacgaggaccacgcccactggacggaggccaagatgctgctcgacaacatcaacacccccgaggggatcatccccgccctgttcgagccggagcgcgagaagtccgccgcgatcgacggcgagtaccggctgcgcggggaggcccggaagaccttcgtggagctcatgcgccggggcgacctgcccgtgtggctgtcctacaaggtcgccagcgaggggttccagtacagcgaccgccggtggtgcttcgacggcgagcgcaacaaccaggtgctcgaggagaacatggacgtggagatctggaccaaggagggcgagcggaagaagctgcgcccccggtggctggacgcccgcacgtactccgaccccctcgccctgcgggagttcaaggagttcgcggccgggcgccggagcgtctccggcgacctgatcctcgagatcgggaagctgccgcagcacctgacccagcgcgcccagaacgccctcgacaacctggtgatgctgcacaacagcgagcagggcggccgggcgtaccgccacgccatggaggagctccccgacaccatcgagaccctgatgctgctcgccctgatcgccgtgctgaccggcggggtcaccctcttcttcctgtccgggaaggggctggggaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcggcctcctgttcatgatcctgaccgtggccgcgaacgagatggggctcctggagacgaccaagaaggacctgggcatcgggcacgtggccgtcgagaaccaccaccacgccgccatgctcgacgtggacctgcaccccgcctccgcgtggaccctgtacgccgtggccaccacgatcatcaccccgatgatgcggcacaccatcgagaacaccacggccaacatcagcctcaccgccatcgcgaaccaggccgccatcctgatgggcctggacaaggggtggcccatctccaagatggacatcggcgtccccctcctggccctgggctgctacagccaggtgaaccccctcaccctgaccgcggccgtgctgatgctcgtcgcccactacgccatcatcgggccgggcctgcaggccaaggcgacgcgcgaggcccagaagcgcaccgccgccgggatcatgaagaaccccaccatcgacggcatcgtggccatcgacctggaccccgtggtctacgacgcgaagttcgagaagcagctcgggcagatcatgctgctgatcctctgcacctcccagatcctgctgatgcggacgacctgggccctctgcgagagcatcaccctggccaccggccccctgacgaccctctgggagggctccccggggaagttctggaacaccaccatcgccgtgagcatggccaacatcttccgcggctcctacctggcgggggccggcctggccttcagcctcatgaagtccctgggcgggggccggcgcgggacgggcgcccagggggagaccctgggcgagaagtggaagcggcagctcaaccagctgtccaagagcgagttcaacacctacaagcgctccggcatcatggaggtggaccggagcgaggcgaaggaggggctgaagcgcggcgagaccacgaagcacgccgtctcccgggggaccgccaagctccgctggttcgtggagcggaacctggtgaagcccgagggcaaggtcatcgacctggggtgcggccgcggcgggtggagctactactgcgccggcctgaagaaggtgaccgaggtgaaggggtacaccaagggcgggcccggccacgaggagcccatcccgatggccacgtacggctggaacctcgtcaagctgcactccgggaaggacgtgttcttcatcccgcccgagaagtgcgacaccctgctctgcgacatcggcgagagctcccccaacccgaccatcgaggaggggcggaccctgcgcgtgctgaagatggtcgagccctggctccggggcaaccagttctgcatcaagatcctgaacccctacatgcccagcgtggtggagacgctggagcagatgcagcgcaagcacgggggcatgctcgtccggaacccgctgtcccgcaacagcacccacgagatgtactgggtgtcctgcggcaccgggaacatcgtgagcgcgatcaacatgacctcccggatgctgctcaaccgcttcaccatggcccaccgcaagcccacgtacgagcgggacgtcgacctgggcgccgggacccgccacgtggccgtggagcccgaggtcgccaacctggacatcatcggccagcggatcgagaacatcaagcacgagcacaagagcacctggcactacgacgaggacaacccctacaagacctgggcgtaccacggctcctacgaggtgaagccgagcgggtccgccagcagcatggtgaacggcgtcgtgaagctcctgacgaagccctgggacgtcatccccatggtgacccagatcgccatgaccgacaccacgcccttcgggcagcagcgcgtgttcaaggagaaggtcgacacccggaccccgaaggccaagcgcggcaccgcccagatcatggaggtgacggcgcggtggctgtgggggttcctctcccgcaacaagaagccccggatctgcacccgcgaggagttcacccggaaggtgcgcagcaacgccgccatcggcgccgtcttcgtggacgagaaccagtggaactccgcgaaggaggccgtggaggacgaccggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggggcgcgcttcctggagttcgaggccctcggcttcatgaacgaggaccactggttctcccgggagaacagcctgtccggcgtggagggggagggcctgcacaagctcgggtacatcctgcgcgacatcagcaagatccccggcgggaacatgtacgccgacgacacggccggctgggacacccggatcaccgaggacgacctgcagaacgaggccaagatcaccgacatcatggagccggagcacgcgctcctggccaagtccatcttcaagctgacgtaccagaacaaggtcgtgcgcgtgcagcgccccgccaagaacggcaccgtcatggacgtgatcagccggcgcgaccagcgggggtccggccaggtggggacctacggcctcaacaccttcacgaacatggaggcccagctgatccgccagatggagagcgagggcatcttcctgcccaacgagctcgagacccccaacctggccgggcgggtcctggactggctcgagaagtacggcgtggagcgcctgaagcggatggcgatctccggggacgactgcgtggtcaagccgatcgacgaccgcttcgccaccgccctgaccgccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggcgggctggtccctccgcgagacggcctgcctgggcaagagctacgcccagatgtggcagctgatgtacttccaccggcgcgacctccggctggccgcgaacgccatctgcagcgccgtgcccgtggactgggtccccacctcccgcaccacctggagcatccacgcccaccaccagtggatgacgaccgaggacatgctgtccgtgtggaaccgggtgtggatcgaggagaacccctggatggaggacaagacccgcatcagctcctgggaggacgtcccgtacctcggcaagcgcgaggaccagtggtgcgggagcctgatcggcctgaccgcccgggcgacgtgggccaccaacatccaggtggccatcaaccaggtgcgccggctcatcggcaacgagaactactccgactacatgaccagcatgaagcgcttcaagaacgagtccgagcccgagggggccctgtggtga

SEQ ID NO: 8659 - RNA, 9879 nt, synthetic construct
  misc_feature 1..9879: note = derived and/or modified CDS sequence (opt1) from DENV-1__GU131750__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccatcgagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgacgctgctggccgtgtccggcgtgtacccgctcagcatccccgccaccctgttcgtctggtacttctggcagaagaagaagcagcgctccggggtgctgtgggacacccccagcccgcccgaggtgggccgggccgtcctcgacgacggcatctaccgcatcatgcagcgggggctgctgggccgctcccaggtgggggtgggcgtcttccaggagaacgtgttccacaccatgtggcacgtgacgcgcggggccgtcctgatgtaccagggcaagcgcctcgagcccagctgggcgtccgtgaagaaggacctgatcagctacggcgggggctggcggctgcaggggtcctggaacaccggcgaggaggtgcaggtcatcgccgtggagcccgggaagaaccccaagaacgtgcagaccgcccccggcaccttcaagacgcccgagggcgaggtcggggccatcgccctcgacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctgcccgagatcgaggacgaggtcttccggaagcgcaacctcaccatcatggacctgcaccccgggagcggcaagacccggcgctacctgccggcgatcgtgcgggaggccatcaagcgcaagctccgcaccctgatcctggcccccacgcgggtggtcgcctccgagatggccgaggcgctcaagggcatgcccatccgctaccagaccaccgccgtcaagagcgagcacaccgggaaggagatcgtggacctgatgtgccacgccacgttcaccatgcggctgctctcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctgtcccggaagacgttcgacaccgagtaccagaagaccaagaacaacgactgggactacgtggtcaccacggacatcagcgagatgggggccaacttccgcgcggaccgggtgatcgacccgcgccggtgcctcaagcccgtgatcctgaaggacggccccgagcgcgtcatcctggccgggcccatgccggtgaccgtcgcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccggctgcgcggggaggcgcggaagacgttcgtggagctgatgcgccggggcgacctccccgtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgccgcggggcgccggagcgtctccggcgacctgatcctggagatcggcaagctcccgcagcacctgatgcagcgcgcccagaacgccctggacaacctcgtgatgctgcacaacagcgagcagggcgggcgggcctaccgccacgcgatggaggagctgcccgacaccatcgagacgctcatgctgctggccctcatcgccgtgctgaccgggggcgtcaccctgttcttcctctccgggcggggcctgggcaagaccagcatcgggctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcggcctcctcttcatgatcctgacggtggccgccaacgagatggggctgctcgagaccaccaagaaggacctgggcatcgggcacgtggcggtcgagaaccaccaccacgccgccatgctggacgtggacctccaccccgcctccgcctggaccctgtacgcggtggccacgaccatcatcaccccgatgatgcgccacaccatcgagaacacgaccgccaacatcagcctgaccgccatcgccaaccaggcggccatcctcatgggcctggacaagggctggcccatctccaagatggacatcggggtccccctgctcgccctgggctgctacagccaggtgaaccccctgaccctcacggccgcggtgctgatgctggtcgcccactacgccatcatcgggccgggcctccaggccaaggccacccgcgaggcgcagaagcggaccgccgccgggatcatgaagaaccccaccgtggacggcatcgtggccatcgacctggaccccgtcgtgtacgacgccaagttcgagaagcagctgggccagatcatgctcctgatcctgtgcacgtcccagatcctcctgatgcgcaccacctgggcgctgtgcgagagcatcaccctcgccacggggcccctgaccaccctgtgggagggctccccggggaagttctggaacaccacgatcgccgtgagcatggccaacatcttccggggctcctacctcgccggcgcggggctggccttcagcctgatgaagtccctcggcgggggccgccgggggaccggcgcccagggcgagaccctgggggagaagtggaagcgccagctgaaccagctctccaagagcgagttcaacacctacaagcggtccggcatcatggaggtcgaccgcagcgaggccaaggaggggctgaagcggggcgagacgaccaagcacgcggtgtcccgcgggaccgccaagctgcggtggttcgtggagcgcaacctcgtcaagcccgagggcaaggtgatcgacctgggctgcgggcggggcgggtggagctactactgcgccggcctgaagaaggtgaccgaggtcaaggggtacacgaagggcggccccgggcacgaggagcccatcccgatggccacctacggctggaacctggtgaagctccactccgggaaggacgtgttcttcatcccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgccgtgaacatgacctcccgcatgctgctgaaccgcttcacgatggcgcaccggaagcccacctacgagcgcgacgtggacctcggcgccggcacccggcacgtcgccgtggagcccgaggtggccaacctggacatcatcgggcagcgcatcgagaacatcaagcacgagcacaagagcacctggcactacgacgaggacaacccctacaagacgtgggcctaccacggctcctacgaggtcaagccgagcgggtccgcgagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgccaagtggctgtggggcttcctgtcccgcaacaagaagccccggatctgcacccgcgaggagttcacccggaaggtgcgcagcaacgcggccatcggggccgtgttcgtcgacgagaaccagtggaactccgccaaggaggcggtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcccgcatcacggacaccatggagccggagcacgccctgctcgcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctgaacaccttcaccaacatggaggcccagctcatccggcagatggagagcgagggcatcttctcccccagcgagctggagacccccaacctggccgagcgcgtgctcgactggctggagaagtacggggtcgagcggctgaagcgcatggccatctccggcgacgactgcgtggtgaagccgatcgacgaccggttcgcgacggccctcaccgccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgccgggtggagcctgcgggagaccgcgtgcctgggcaagtcctacgcccagatgtggcagctcatgtacttccaccgccgggacctgcgcctggccgccaacgcgatctgcagcgccgtccccgtggactggatccccacctcccggacgacctggagcatccacgcccaccaccagtggatgaccaccgaggacatgctctccgtgtggaaccgcgtctggatcgaggagaacccctggatggaggacaagacgcacatcagctcctggggcgacgtgccgtacctgggcaagcgcgaggaccagtggtgcggcagcctgatcgggctcaccgcccgggccacctgggcgaccaacatccaggtggccatcaaccaggtccgccggctgatcggcaacgagaactacctggactacatgacctccatgaagcgcttcaagaacgagagcgaccccgagggggccctctggtga

SEQ ID NO: 8660 - RNA, 9879 nt, synthetic construct
  misc_feature 1..9879: note = derived and/or modified CDS sequence (opt1) from DENV-1__GU131751__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggggagttctgcgaggacacgatgacctacaagtgcccccgcatcaccgaggccgagcccgacgacgtggactgctggtgcaacgccaccgacacctgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccatcgcgaccatcacgccccaggcccccagcaccgagatccagctgacggactacggggccctcaccctggactgcagcccccgcaccggcctggacttcaacgagatggtcctcctgaccatgaaggagaagtcctggctggtgcacaagcagtggttcctcgacctgccgctgccctggacgagcggggcctccaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacctccgtcgggaagctggtgcaccagatcttcggcacggcctacggggtgctgttcagcggcgtctcctggaccatgaagatcgggatcggcgtgctcctgacctggctgggcctcaacagccgctccaccagcctgtccatgacgtgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacctggacggagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaaggtgatccggccccagcccatggagcacaagtactcctggaagtcctggggcaaggccaagatcatcggcgccgacgtccagaacaccaccttcatcatcgacgggcccaacacgccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatccgggactccaaggccgtccacgccgacatgggctactggatcgagagcgagaagaacgagacgtggaagctcgcgcgcgcctccttcatcgaggtgaagacctgcatctggcccaagagccacaccctgtggtccaacggcgtgctggagagcgagatgatcatccccaagatctacgggggcccgatctcccagcacaactaccggcccgggtacttcacccagacggccggcccctggcacctcgggaagctggagctggacttcgacctctgcgagggcaccaccgtcgtggtggacgagcactgcggcaaccgcgggccgagcctgcggaccacgaccgtcaccggcaagatcatccacgagtggtgctgccgctcctgcaccctgccgcccctgcggttcaagggggaggacggctgctggtacgggatggagatccgccccgtgaaggagaaggaggagaacctggtcaagagcatggtcagcgccggctccggcgaggtggacagcttctccctggggctcctgtgcatcagcatcatgatcgaggaggtgatgcggtccaagtggagccgcaagatgctgatgacgggcaccctcgccgtcttcttcctgctgatcatggggcagctcacctggaacgacctgatccggctgtgcatcatggtgggcgcgaacgcctccgaccgcatggggatgggcaccacgtacctcgccctgatggccaccttcaagatgcgcccgatgttcgccgtgggcctcctgttccggcgcctgaccagccgggaggtcctgctcctgaccatcgggctgtccctcgtggcgagcgtcgagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtgctgtccatcgtgagcctgttccccctctgcctgtccaccaccagccagaagacgacctggctgcccgtcctcctgggctccctggggtgcaagccgctcaccatgttcctgatcgccgagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggaccatgaagatcaaggacgaggagcgggacgacacgctgaccatcctgctcaaggccaccctgctggccgtgagcggcgtctacccgctctccatccccgccaccctgttcgtgtggtacttctggcagaagaagaagcagcgcagcggggtgctgtgggacatccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacgcggggcgcggtgctgatgtaccaggggaagcgcctcgagccctcctgggccagcgtgaagaaggacctgatctcctacggcggcgggtggcggctgcagggcagctggaacaccggggaggaggtccaggtgatcgccgtggagcccggcaagaaccccaagaacgtccagaccgcccccgggaccttcaagacgtccgagggcgaggtgggcgccatcgcgctcgacttcaagcccgggaccagcggcagccccatcgtgaaccgcgaggggaagatcgtcggcctgtacggcaacggggtggtgaccacctccggcacgtacgtcagcgccatcgcccaggccaaggcgtcccaggaggggcccctgccggagatcgaggacgaggtgttcaagaagcggaacctcaccatcatggacctgcaccccggcagcgggaagacccgccggtacctgcccgccatcgtgcgcgaggccatcaagcggaagctccgcaccctgatcctggccccgacgcgggtcgtggcctccgagatggcggaggccctcaagggcatgcccatccgctaccagaccaccgccgtcaagagcgagcacaccggcaaggagatcgtcgacctgatgtgccacgccacgttcaccatgcgcctgctctcccccgtgcgggtgcccaactacaacatgatcatcatggacgaggcccacttcaccgacccgagctccatcgcggcccgcgggtacatcagcacccgggtcggcatgggggaggccgccgccatcttcatgacggcgacgccgcccggctccgtggaggccttcccccagagcaacgccgtgatccaggacgaggagcgcgacatcccggagcggtcctggaacagcgggtacgagtggatcaccgacttccccggcaagaccgtctggttcgtgccctccatcaagagcggcaacgacatcgccaactgcctgcgcaagaacgggaagcgggtgatccagctgtcccgcaagacgttcgacaccgagtaccagaagaccaagaacaacgactgggactacgtcgtgaccacggacatcagcgagatgggcgcgaacttccgggccgaccgcgtgatcgacccccggcgctgcctcaagccggtcatcctgaaggacgggcccgagcgggtgatcctggccggccccatgcccgtcaccgtggcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccggctgcgcggcgaggcccgcaagacgttcgtggagctgatgcggcgcggggacctcccggtctggctgagctacaaggtggcctccgagggcttccagtacagcgaccggcgctggtgcttcgacggcgagcggaacaaccaggtgctggaggagaacatggacgtcgagatctggaccaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacacgatcgagaccctcatgctgctggccctcatcgccgtcctgaccggcggggtgaccctgttcttcctctccggccgcgggctgggcaagacgagcatcggcctgctctgcgtgatggcctccagcgtcctgctgtggatggcgtccgtggagccccactggatcgccgccagcatcatcctcgagttcttcctgatggtgctgctcatccccgagcccgaccggcagcgcaccccgcaggacaaccagctggcctacgtcgtgatcgggctcctcttcatgatcctgaccgtggccgcgaacgagatgggcctgctcgagaccaccaagaaggacctggggatcggccacgtcgccgtggagaaccaccaccacgccgccatgctggacgtggacctccaccccgcctccgcgtggacgctgtacgccgtcgccaccaccatcatcacccccatgatgcggcacacgatcgagaacaccaccgccaacatcagcctgaccgccatcgcgaaccaggccgccatcctcatggggctggacaagggctggccgatctccaagatggacatcggcgtgcccctgctcgccctggggtgctacagccaggtgaaccccctgacgctcaccgcgaccgtcctgatgctggtggcccactacgccatcatcggccccgggctccaggccaaggccacccgcgaggcgcagaagcggacggccgccggcatcatgaagaacccgaccgtggacgggatcgtcgccatcgacctggaccccgtggtgtacgacgccaagttcgagaagcagctgggccagatcatgctcctgatcctgtgcacctcccagatcctcctgatgcgcaccacgtgggcgctgtgcgagagcatcaccctcgccaccggccccctgaccacgctgtgggaggggtcccccggcaagttctggaacaccaccatcgccgtcagcatggccaacatcttccgcgggagctacctcgccggcgcgggcctggccttctccctgatgaagtccctcgggggcgggcggcgcggcaccggggcccagggcgagacgctgggcgagaagtggaagcggcagctgaaccagctctccaagagcgagttcaacacctacaagcgctccgggatcatggaggtggaccggagcgaggccaaggagggcctgaagcgcggggagaccaccaagcacgcggtgtcccggggcacggccaagctgcgctggttcgtcgagcggaacctcgtgaagccggaggggaaggtgatcgacctgggctgcggccgcgggggctggagctactactgcgccgggctgaagaaggtcaccgaggtgaagggctacaccaagggcgggcccggccacgaggagcccatccccatggccacctacgggtggaacctggtgaagctccactccggcaaggacgtcttcttcatcccgcccgagaagtgcgacacgctgctgtgcgacatcggggagagctcccccaaccccaccatcgaggagggccggaccctccgcgtgctgaagatggtggagccgtggctgcgggggaaccagttctgcatcaagatcctcaacccctacatgcccagcgtcgtggagaccctggagcagatgcagcgcaagcacggcggcatgctggtgcggaaccccctctcccgcaacagcacgcacgagatgtactgggtctcctgcgggaccggcaacatcgtgagcgccgtgaacatgacctcccggatgctgctgaaccgcttcaccatggcgcaccggaagccgacctacgagcgcgacgtcgacctcggggccggcacgcgccacgtggccgtggagcccgaggtcgccaacctggacatcatcggccagcggatcgagaacatcaagcacgagcacaagagcacctggcactacgacgaggacaacccctacaagacctgggcctaccacgggtcctacgaggtgaagcccagcggcagcgcgtccagcatggtcaacggggtggtgaagctgctcaccaagccgtgggacgtcatccccatggtgacgcagatcgccatgaccgacaccacccccttcggccagcagcgcgtgttcaaggagaaggtcgacacgcggacccccaaggccaagcgcgggaccgcccagatcatggaggtgaccgccaagtggctgtggggcttcctgtcccggaacaagaagccgcgcatctgcacgcgggaggagttcacccgcaaggtgcggagcaacgcggccatcggcgccgtcttcgtggacgagaaccagtggaactccgccaaggaggcggtggaggacgagcgcttctgggacctcgtccaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacgcgcatcaccgaggacgacctgcagaacgaggccaagatcaccgacatcatggagcccgagcacgccctgctcgcgaagtccatcttcaagctgacctaccagaacaaggtcgtgcgggtgcagcgcccggccaagaacgggacggtcatggacgtgatcagccggcgcgaccagcgcggctccggccaggtgggcacctacggcctgaacaccttcaccaacatggaggcccagctcatccggcagatggagagcgaggggatcttctcccccagcgagctggagacgcccaacctggccggccgcgtcctcgactggctggagaagtacggggtggagcggctgaagcgcatggccatctccggcgacgactgcgtggtcaagcccatcgacgaccggttcgcgaccgccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtcgtgccctgccgcaaccaggacgagctcgtggggcgggcccgcgtctcccagggcgccgggtggagcctgcgggagaccgcgtgcctgggcaagtcctacgcccagatgtggcagctcatgtacttccaccgccgggacctgcgcctggccgccaacgcgatctgcagcgccgtgccggtggactgggtccccacgtcccggaccacctggagcatccacgcccaccaccagtggatgaccacggaggacatgctctccgtgtggaaccgcgtgtggatcgaggagaacccctggatggaggacaagacccacatcagctcctggggcgacgtcccctacctgggcaagcgggaggaccagtggtgcggcagcctgatcgggctcaccgcccgcgccacctgggcgacgaacatccaggtggccatcaaccaggtgcggcgcctgatcggcaacgagaactacctggactacatgacctccatgaagcgcttcaagaacgagagcgacccggagggggccctctggtga

SEQ ID NO: 8661 - RNA, 9879 nt, synthetic construct
  misc_feature 1..9879: note = derived and/or modified CDS sequence (opt1) from DENV-1__GU131753__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccggaccgagacctggatgtccagcgagggcgcctggaagcagatccagcgggtcgagacgtgggccctccgccaccccgggttcaccgtgaccgccctgttcctggcgcacgccatcggcacctccatcacgcagaaggggatcatcttcatcctcctgatgctggtgacccccagcatggccatgcggtgcgtcggcatcggctcccgcgacttcgtggaggggctcagcggcgccacctgggtggacgtcgtgctggagcacgggtcctgcgtgaccacgatggccaaggacaagcccaccctggacatcgagctcctgaagaccgaggtcaccaaccccgcggtgctgcggaagctctgcatcgaggccaagatcagcaacacgaccaccgactcccgctgccccacccagggcgaggccacgctgatggaggagcaggacgccaacttcgtgtgccggcgcaccttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgacggtgcacaccggcgaccagcaccaggtcgggaacgagagcaccgagcacggcaccaccgcgacgatcacgccccaggcccccacctccgagatccagctcaccgactacggggccctgacgctggactgcagcccccgcaccggcctcgacttcaacgagatggtgctgctgaccatgaaggagaagtcctggctcgtccacaagcagtggttcctggacctgccgctcccctggaccagcggggccagcacgtcccaggagacctggaaccggcaggacctgctggtgaccttcaagaccgcccacgcgaagaagcaggaggtggtcgtgctcggcagccaggagggcgccatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgcggagacccagcacggcaccgtgctggtgcagatcaagtacgagggcaccgacgccccctgcaagatccccttcagcacgcaggacgagaagggggtcacccagaacggccggctgatcaccgccaacccgatcatcaccgacaaggagaagcccgtgaacatcgaggccgagccgcccttcggggagtcctacatcgtgatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtcttcaccagcatcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggtgggcatcctcgcgcaggggaagaagatgatccggccccagcccatggagcacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagatgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtcgtggtggacgagcactgcggcaaccgggggccgtccctgcgcaccaccacggtcaccggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctggggctcctgtgcatctccatcatgatcgaggaggtgatgcgcagccggtggtcccgcaagatgctgatgaccggcacgctcgccgtcttcctgctgctcatcatggggcagctgacctggaacgacctgatccggctctgcatcatggtgggcgccaacgcgagcgaccgcatggggatgggcaccacctacctggccctgatggccacgttcaagatgcgcccgatgttcgccgtgggcctcctgttccggcgcctgacctcccgggaggtcctcctgctgaccatcgggctcagcctggtggcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccctgtccctgcactacgcctggaagacgatggccatggtcctcagcatcgtgtccctgatccccctgtgcctcagcaccacctcccagaagaccacgtggctgcccgtcctgctcggcagcctggggtgcaagccgctgaccatgttcctcatcgcggagaacaagatctggggccgcaagtcctggcccctgaacgaggggatcatggccgtgggcgtggtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatgaagcgcaagctgcggaccctcatcctggcccccacgcgcgtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcacggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggcggtggagaaccaccaccacgccaccatgctggacgtcgacctgcaccccgcctccgcctggaccctctacgccgtggcgaccacgatcatcaccccgatgatgcgccacaccatcgagaacaccacggccaacatcagcctgaccgccatcgccaaccaggccgcgatcctgatggggctcgacaagggctggcccatctccaagatggacatcggcgtgcccctgctggccctcgggtgctacagccaggtcaaccccctgaccctgaccgccgccgtgctcatgctggtggcgcactacgccatcatcggcccggggctgcaggccaaggccacgcgggaggcccagaagcgcaccgcggccggcatcatgaagaaccccaccgtcgacgggatcgtggccatcgacctcgaccccgtggtctacgacgccaagttcgagaagcagctgggccagatcatgctgctcatcctgtgcacctcccagatcctgctcatgcgcacgacctgggccctgtgcgagagcatcaccctggcgaccggccccctcacgaccctgtgggaggggtccccgggcaagttctggaacaccaccatcgccgtgagcatggccaacatcttccgggggtcctacctggccggcgccggcctcgcgttcagcctgatgaagtccctcgggggcgggcgccgggggacgggggcccagggcgagaccctcggcgagaagtggaagcgccagctgaaccagctgtccaagagcgagttcaacatctacaagcggtccgggatcatggaggtggaccgcagcgaggccaaggagggcctcaagcgcggggagaccaccaagcacgccgtctcccgcggcacggcgaagctgcggtggttcgtggagcgcaacctggtgaagcccgaggggaaggtcatcgacctgggctgcggccgcggcgggtggagctactactgcgccgggctcaagaaggtgaccgaggtgaaggggtacaccaagggcgggcccggccacgaggagcccatcccgatggccacctacgggtggaacctggtcaagctgcactccggcaaggacgtgttcttcacgccgcccgagaagtgcgacaccctcctgtgcgacatcggggagagctcccccaacccgaccatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacgcacgagatgtactgggtgtcctgcgggaccggcaacatcgtgagcgccgtcaacatgacctcccgcatgctcctgaaccggttcaccatggcccaccgcaagcccacgtacgagaaggacgtggacctgggggcgggcacccgccacgtggccgtcgagcccgaggtggccaacctcgacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtcaagctgctgacgaagccctgggacgtgatccccatggtgacccagatcgcgatgaccgacaccacgcccttcggccagcagcgcgtcttcaaggagaaggtggacacccggaccccgaaggccaagcgcgggaccgtgcagatcatggaggtcacggcccggtggctctggggcttcctgtcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctggtgaagaaggagcgcgagctccacaagcaggggaagtgcgcgacctgcgtctacaacatgatgggcaagcgggagaagaagctgggggagttcggcaaggcgaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacacggcgggctgggacacccgcatcaccgaggacgacctccagaacgaggccaagatcaccgacatcatggagccggagcacgccctgctggccacgtccatcttcaagctcacctaccagaacaaggtggtccgggtgcagcgccccgccaagaacgggaccgtgatggacgtcatcagccggcgcgaccagcgcggctccggccaggtgggcacctacggcctgaacacgttcaccaacatggaggcgcagctgatccggcagatggagagcgaggggatcttcctcccctccgagctggagacccccaacctggccgagcgcgtgttcgactggctcgagaagtacggcgtcgagcggctgaagcgcatggccatcagcggggacgactgcgtggtgaagccgatcgacgaccggttcgccaccgccctgacggcgctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcccgcgtgtcccagggggccggctggagcctccgggagaccgcctgcctgggcaagagctacgcccagatgtggcagctgatgtacttccaccgccgggacctccgcctggcggccaacgccatctgctccgccgtccccgtggactgggtgcccaccagccggaccacgtggtccatccacgcgcaccaccagtggatgaccaccgaggacatgctgagcgtctggaaccgcgtgtggatcgaggagaacccctggatggaggacaagacccacgtgtccagctggggcgacgtcccgtacctcgggaagcgggaggaccagtggtgcggctccctgatcggcctgaccgcccgcgccacgtgggccagcaacatccaggtggccatcaaccaggtgcggcgcctcatcgggaacgagaactacctggactacatgacctccatgaagcgcttcaagaacgagggcgaccccgagggggcgctgtggtga

SEQ ID NO: 8662 - RNA, 9879 nt, synthetic construct
  misc_feature 1..9879: note = derived and/or modified CDS sequence (opt1) from DENV-1__GU131754__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggacaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcgtgaactggaagggccgggagctgaagtgcgggagcggcatcttcgtgaccaacgaggtccacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtgagcctgttccccctctgcatgtccaccacgagccagaagaccacctggctgcccgtcctgctcggctccctggggtgcaagccgctgaccatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgctgtccatccccgccaccctcttcgtgtggtacttctggcagaagaagaagcagcgcagcggggtgctgtgggacacgcccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgcggtgctgatgtaccaggggaagcgcctggagccctcctgggccagcgtgaagaaggacctcatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgcgaggggaagatcgtcggcctctacggcaacggggtggtgacgacctccggcacctacgtcagcgccatcgcccaggccaaggcgtcccaggaggggcccctgccggagatcgaggacgaggtgttccggaagcgcaacctgaccatcatggacctccaccccggcagcgggaagacgcggcgctacctgcccgccatcgtgcgggaggccatcaagcgcaagctgcggaccctcatcctggccccgacccgcgtcgtggcctccgagatggcggaggccctgaagggcatgcccatccgctaccagaccacggccgtcaagagcgagcacaccggcaaggagatcgtcgacctcatgtgccacgccaccttcaccatgcggctgctgtcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctccggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctgaagccggtcatcctcaaggacgggcccgagcgcgtgatcctggccggccccatgcccgtcaccgtggcctccgccgcgcagcggcgcgggcggatcggccgcaaccacaacaaggagggcgaccagtacgtgtacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtcgagctgatgcgccgcggggacctgccggtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccccagcacctcacccagcgcgcccagaacgccctggacaacctggtcatgctccacaacagcgagcagggcgggcgggcgtaccgccacgccatggaggagctgccggacaccatcgagaccctgatgctcctggccctgatcgccgtgctcacgggcggggtgaccctgttcttcctgtccggccgggggctcggcaagaccagcatcggcctgctgtgcgtcatggcctccagcgcgctcctgtggatggcctccgtggagccccactggatcgccgccagcatcatcctggagttcttcctcatggtgctgctgatccccgagcccgaccgccagcggaccccgcaggacaaccagctcgcctacgtcgtgatcgggctgctgttcatgatcctcaccgtggcggccaacgagatgggcctgctggagacgaccaagaaggacctcgggatcggccacgtcgccgtggagaaccaccaccacgccgccatgctggacgtggacctgcaccccgcgtccgcctggaccctctacgccgtcgccaccacgatcatcacccccatgatgcgccacaccatcgagaacaccacggccaacatcagcctgaccgcgatcgccaaccaggccgccatcctgatggggctcgacaagggctggccgatctccaagatggacatcggcgtgcccctgctggcgctcgggtgctacagccaggtgaaccccctgaccctgaccgccgccgtcctcatgctggtggcccactacgccatcatcggccccgggctgcaggcgaaggccacgcgggaggcccagaagcgcaccgccgccggcatcatgaagaacccgaccgtggacgggatcgtcgcgatcgacctcgaccccgtggtgtacgacgccaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtcagcatggcgaacatcttccgggggagctacctggccggcgccggcctcgccttctccctgatgaagtccctcgggggcgggcgccgggggacgggggcgcagggcgagaccctcggcgagaagtggaagcgccagctgaaccagctgtccaagagcgagttcaacacctacaagcggtccgggatcatggaggtggaccgcagcgaggccaaggagggcctcaagcgcggggagaccacgaagcacgccgtgtcccgcggcaccgccaagctgcggtggttcgtcgagcgcaacctggtgaagccggaggggaaggtgatcgacctcggctgcggccgcggcgggtggagctactactgcgccgggctgaagaaggtcaccgaggtgaaggggtacaccaagggcgggcccggccacgaggagcccatccccatggcgacgtacgggtggaacctggtgaagctgcactccggcaaggacgtcttcttcatcccgcccgagaagtgcgacaccctcctgtgcgacatcggggagagctcccccaaccccaccatcgaggagggccgcaccctgcgggtgctcaagatggtggagccgtggctgcgcgggaaccagttctgcatcaagatcctgaacccctacatgcccagcgtcgtggagacgctcgagcagatgcagcggaagcacggcggcatgctggtgcgcaaccccctgtcccggaacagcacccacgagatgtactgggtctcctgcgggaccggcaacatcgtgagcgccgtgaacatgacctcccgcatgctcctgaaccggttcaccatggcccaccgcaagccgacgtacgagcgcgacgtcgacctgggggccggcacccggcacgtggccgtggagcccgaggtcgcgaacctcgacatcatcggccagcgcatcgagaacatcaagcacgagcacaagagcacctggcactacgacgaggacaacccctacaagacctgggcctaccacgggtcctacgaggtgaagcccagcggcagcgcctccagcatggtcaacggggtggtgaagctgctgacgaagccgtgggacgtcatccccatggtgacccagatcgccatgaccgacaccacgcccttcggccagcagcgggtgttcaaggagaaggtcgacacccgcacccccaaggccaagcgggggaccgcgcagatcatggaggtgacggccaagtggctctggggcttcctgtcccgcaacaagaagccgcggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggcgaagatcaccgacatcatggagcccgagcacgccctgctggccaagtccatcttcaagctcacgtaccagaacaaggtcgtgcgcgtgcagcggccggccaagaacgggaccgtcatggacgtgatcagccgccgcgaccagcggggctccggccaggtgggcacctacggcctgaacaccttcacgaacatggaggcccagctgatccgccagatggagagcgaggggatcttctcccccagcgagctcgagacccccaacctggcgggccgggtcctggactggctcgagaagcacggggtggagcgcctgaagcggatggccatctccggcgacgactgcgtggtcaagcccatcgacgaccgcttcgccaccgccctgaccgccctcaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctggtggggcgcgcgcgggtctcccagggcgccgggtggagcctccgcgagacggcctgcctgggcaagtcctacgcccagatgtggcagctgatgtacttccaccggcgcgacctccggctggcggccaacgccatctgcagcgccgtgccggtggactgggtccccacctcccgcaccacctggagcatccacgcccaccaccagtggatgacgaccgaggacatgctgtccgtgtggaaccgggtgtggatcgaggagaacccctggatggaggacaagacccacatcagctcctggggcgacgtcccctacctcggcaagcgcgaggaccagtggtgcggcagcctgatcgggctgaccgcgcgggccacgtgggccaccaacatccaggtggccatcaaccaggtgcgccgcctcatcggcaacgagaactacctggactacatgacctccatgaagcggttcaagaacgagagcgacccggagggggccctgtggtga

SEQ ID NO: 8663 - RNA, 9879 nt, synthetic construct
  misc_feature 1..9879: note = derived and/or modified CDS sequence (opt1) from DENV-1__GU131755__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatccgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactgcgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggacaagcagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcatcgacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctggagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8664 - RNA, 9879 nt, synthetic construct
  misc_feature 1..9879: note = derived and/or modified CDS sequence (opt1) from DENV-1__GU131756__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgcgttcttcctgctcatcatggggcagctgacctggaacgacctgatccggctctgcatcatggtgggcgccaacgcctccgaccgcatggggatgggcacgacctacctggccctgatggccaccttcaagatgcgcccgatgttcgcggtcgggctcctgttccggcgcctgaccagccgggaggtgctcctgctgacgatcgggctctccctggtggccagcgtcgagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcgtggaagaccatggccatggtgctgtccatcgtcagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtgggcatcgtcagcatcctgctgtccagcctcctgaagaacgacgtgcccctggccgggcccctcatcgcgggcggcatgctgatcgcctgctacgtgatctccgggagctccgccgacctgagcctcgagaaggccgccgtcgtgtcctgggaggaggaggcggagcacagcggcgcctcccacaacatcctggtggaggtccaggacgacgggacgatgaagatcaaggacgaggagcgcgacgacaccctgaccatcctcctgaaggccaccctgctcgccgtgagcggcgtgtacccgctgtccatccccgccaccctgttcgtctggtacttctggcagaagaagaagcagcggagcggggtgctctgggacacgcccagcccgcccgaggtggagcgcgcggtcctggacgacggcatctaccggatcatgcagcgcggcctgctggggcggagccaggtgggcgtgggggtcttccaggagaacgtgttccacaccatgtggcacgtgacccgcggcgccgtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagacctccgagggcgaggtcggcgcgatcgccctggacttcaagcccgggaccagcggcagccccatcgtgaaccgggaggggaagatcgtgggcctgtacggcaacggggtcgtgacgacctccggcacctacgtgagcgccatcgcccaggcgaaggcctcccaggaggggcccctcccggagatcgaggacgaggtcttccgcaagcggaacctgaccatcatggacctgcaccccggcagcgggaagacgcgccggtacctccccgccatcgtgcgcgaggccatcaagcggaagctgcgcaccctgatcctcgccccgacccgcgtggtcgcgtccgagatggccgaggccctgaagggcatgcccatccggtaccagaccacggccgtcaagagcgagcacaccggcaaggagatcgtggacctgatgtgccacgccaccttcaccatgcgcctcctgtcccccgtccgggtgcccaactacaacatgatcatcatggacgaggcgcacttcacggacccgagctccatcgccgcccgcgggtacatcagcacccgggtgggcatgggggaggccgccgcgatcttcatgaccgccacgccgcccggctccgtcgaggccttcccccagagcaacgccgtgatccaggacgaggagcgcgacatcccggagcggtcctggaacagcgggtacgagtggatcacggacttccccggcaagaccgtgtggttcgtcccctccatcaagagcggcaacgacatcgcgaactgcctgcgcaagaacgggaagcgggtgatccagctctcccgcaagaccttcgacaccgagtaccagaagacgaagaacaacgactgggactacgtggtcaccaccgacatcagcgagatgggcgccaacttccgggccgaccgcgtgatcgacccccggcgctgcctgaagccggtgatcctgaaggacgggcccgagcgggtcatcctcgccggccccatgcccgtgaccgtcgcctccgcggcccagcgccgggggcgcatcggccggaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgcggccatcgacggggagtaccgcctgcggggcgaggcccgcaagaccttcgtggagctcatgcggcgcggggacctgccggtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgaccccctcgcgctgcgcgagttcaaggagttcgccgccggccggcgcagcgtctccggggacctgatcctcgagatcggcaagctgccccagcacctgacccagcgggcccagaacgcgctcgacaacctggtgatgctgcacaacagcgagcagggcgggcgcgcctaccggcacgccatggaggagctcccggacaccatcgagaccctgatgctgctcgccctgatcgccgtgctgacgggcggggtcaccctcttcttcctgtccggccgcgggctgggcaagaccagcatcggcctcctgtgcgtgatggcgtccagcgtgctgctctggatggcctccgtcgagccccactggatcgccgccagcatcatcctggagttcttcctgatggtgctcctgatccccgagcccgaccggcagcgcaccccgcaggacaaccagctggcctacgtggtcatcgggctcctgttcatgatcctgaccgtggcggccaacgagatgggcctcctggagacgaccaagaaggacctggggatcggccacgtggccgtcgagaaccaccaccacgccgccatgctcgacgtggacctgcaccccgcgtccgcctggaccctgtacgccgtggccaccacgatcatcacccccatgatgcggcacaccatcgagaacaccacggccaacatcagcctcaccgcgatcgccaaccaggccgccatcctgatggggctggacaagggctggccgatctccaagatggacatcggcgtccccctcctggcgctggggtgctacagccaggtgaaccccctcaccctgaccgccgccgtgctgatgctcgtcgcccactacgccatcatcggccccgggctgcaggcgaaggccacgcgcgaggcccagaagcgcaccgccgccggcatcatgaagaacccgaccgtggacgggatcgtggcgatcgacctggaccccgtcgtgtacgacgccaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtgagcatggcgaacatcttccgcgggagctacctggccggcgccggcctggccttctccctcatgaagtccctcgggggcgggcggcgcgggacgggggcgcagggcgagaccctgggcgagaagtggaagcggcagctcaaccagctgtccaagagcgagttcaacacctacaagcgctccgggatcatggaggtcgaccggagcgaggccaaggagggcctgaagcgcggggagaccacgaagcacgccgtgtcccggggcaccgccaagctccgctggttcgtggagcggaacctggtcaagccggaggggaaggtgatcgacctgggctgcggccgcgggggctggagctactactgcgccgggctgaagaaggtgaccgaggtcaagggctacaccaagggcgggcccggccacgaggagcccatccccatggcgacgtacgggtggaacctcgtgaagctgcactccggcaaggacgtgttcttcatcccgcccgagaagtgcgacaccctgctctgcgacatcggggagagctcccccaaccccaccatcgaggagggccggaccctgcgcgtcctgaagatggtggagccgtggctccgggggaaccagttctgcatcaagatcctgaacccctacatgcccagcgtggtcgagacgctggagcagatgcagcgcaagcacggcggcatgctcgtgcggaaccccctgtcccgcaacagcacccacgagatgtactgggtgtcctgcgggaccggcaacatcgtcagcgccgtgaacatgacctcccggatgctgctcaaccgcttcaccatggcccaccgcaagccgacgtacgagcgggacgtggacctgggggccggcacccgccacgtcgccgtggagcccgaggtggcgaacctggacatcatcggccagcggatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctcctgacgaagccgtgggacgtgatccccatggtcacccagatcgccatgaccgacaccacgcccttcggccagcagcgcgtgttcaaggagaaggtggacacccggacccccaaggccaagcgcgggaccgcgcagatcatggaggtcacggccaagtggctgtggggcttcctctcccggaacaagaagccgcgcatctgcacccgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcgaagatcaccgacatcatggagcccgagcacgccctcctggccaagtccatcttcaagctgacgtaccagaacaaggtggtccgggtgcagcgcccggccaagaacgggaccgtgatggacgtcatcagccgccgggaccagcgcggctccggccaggtgggcacctacggcctcaacaccttcacgaacatggaggcccagctgatccggcagatggagagcgaggggatcttctcccccagcgagctggagacccccaacctcgcgggccgcgtgctggactggctggagaagcacggggtcgagcggctcaagcgcatggccatctccggcgacgactgcgtggtgaagcccatcgacgaccggttcgccaccgccctgaccgccctgaacgacatggggaaggtccgcaaggacatcccgcagtgggagcccagcaagggctggaacgactggcagcaggtccccttctgcagccaccacttccaccagctcatcatgaaggacggccgggagatcgtggtcccctgccgcaaccaggacgagctggtggggcgggcgcgcgtgtcccagggcgccgggtggagcctgcgggagacggcctgcctcggcaagtcctacgcccagatgtggcagctgatgtacttccaccgccgggacctgcgcctcgcggccaacgccatctgcagcgccgtcccggtggactgggtgcccacctcccggaccacctggagcatccacgcccaccaccagtggatgacgaccgaggacatgctgtccgtctggaaccgcgtgtggatcgaggagaacccctggatggaggacaagacccacatcagctcctggggcgacgtgccctacctgggcaagcgggaggaccagtggtgcggcagcctcatcgggctgaccgcgcgcgccacgtgggccaccaacatccaggtcgccatcaaccaggtgcgccggctgctcggcaacgagaactacctggactacatgacctccatgaagcgcttcaagaacgagagcgacccggagggggccctgtggtga

SEQ ID NO: 8665 - RNA, 9879 nt, synthetic construct
  misc_feature 1..9879: note = derived and/or modified CDS sequence (opt1) from DENV-1__GU131758__SS-prME
  source 1..9879: mol_type = other RNA
agcgtgacgatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgtgccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccgctccaccagcctgtccatgacctgcatcgccgtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggccgactccccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacgtggaacgacctgatccggctgtgcatcatggtgggcgccaacgcgtccgaccgcatggggatgggcaccacctacctcgccctgatggccaccttcaagatgcgcccgatgttcgccgtgggcctcctgttccggcgcctgacgagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccaccctcctgtccttcacgttcatcaagaccaccttcagcctgcactacgcctggaagaccatggccatggtgctctccatcgtgagcctgttccccctgtgcctctccacgaccagccagaagaccacctggctgcccgtcctgctcggctccctggggtgcaagccgctgacgatgttcctcatcgcggagaacaaggtgtggggccgcaagagctggcccctgaacgaggggatcatggccgtgggcatcgtcagcatcctgctctccagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgaccctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacaccatgtggcacgtgacccggggcgccgtgctgatgtaccaggggaagcgcctggagccctcctgggcgagcgtcaagaaggacctcatctcctacggcggcgggtggcggctgcagggcagctggaacacgggggaggaggtccaggtgatcgccgtcgagcccggcaagaaccccaagaacgtgcagaccgcccccgggaccttcaagacctccgagggcgaggtgggcgccatcgccctggacttcaagcccgggacgagcggcagccccatcgtcaaccgcgaggggaagatcgtgggcctctacggcaacggggtggtcaccacctccggcacctacgtgagcgcgatcgcccaggccaaggcctcccaggaggggcccctgccggagatcgaggacgaggtgttccggaagcgcaacctgacgatcatggacctccaccccggcagcgggaagacccggcgctacctgcccgcgatcgtccgggaggccatcaagcgcaagctgcggaccctcatcctggccccgacccgcgtggtggcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtgcgcgtccccaactacaacatgatcatcatggacgaggcccacttcaccgacccgagctccatcgccgcgcgggggtacatcagcacccgcgtgggcatgggggaggccgccgccatcttcatgaccgccacgccgcccggctccgtggaggcgttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgccaacttccgcgcggaccgggtcatcgacccccgccggtgcctgaagccggtgatcctcaaggacgggcccgagcgcgtcatcctggccggccccatgcccgtgacggtggcctccgccgcccagcggcgcgggcggatcggccgcaaccacaacaaggagggcgaccagtacatctacatggggcagccgctgaacaacgacgaggaccacgcgcactggaccgaggccaagatgctcctggacaacatcaacacccccgagggcatcatccccgccctgttcgagcccgagcgggagaagtccgccgccatcgacggggagtaccgcctccgcggcgaggcgcggaagaccttcgtcgagctgatgcgccgcggggacctgccggtgtggctcagctacaaggtggcctccgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccccagcacctcacccagcgcgcccagaacgccctggacaacctggtcatgctccacaacagcgagcagggcgggcgggcctaccgccacgcgatggaggagctgccggacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagcccgaccgccagcggaccccgcaggacaaccagctcgcctacgtggtgatcgggctgctgttcatgatcctcacggtcgccgccaacgagatgggcctgctggagaccaccaagaaggacctcgggatcggccacgcggccgtggagaaccaccaccacgccgccatgctggacgtggacctgcaccccgcctccgcgtggaccctctacgccgtcgccacgaccatcatcacccccatgatgcgccacaccatcgagaacacgaccgccaacatcagcctgaccgccatcgcgaaccaggccgccatcctgatggggctcgacaagggctggccgatctccaagatggacatcggcgtgcccctgctggccctcgggtgctacagccaggtgaaccccctgaccctgacggcggccgtcctcatgctggtggcccactacgccatcatcggccccgggctgcaggccaaggcgacccgggaggcccagaagcgcaccgccgccggcatcatgaagaacccgaccgtggacgggatcgtcgccatcgacctcgaccccgtggtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgccgtcagcatggccaacatcttccgggggagctacctggcgggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagacgaccaagcacgccgtgtcccgcggcaccgccaagctgcggtggttcgtcgagcgcaacctggtgaagccggaggggaaggtgatcgacctcggctgcggccgcggcgggtggagctactactgcgccgggctgaagaaggtcaccgaggtgaaggggtacacgaagggcgggcccggccacgaggagcccatccccatggccacctacgggtggaacctggtgaagctgcactccggcaaggacgtcttcttcatcccgcccgagaagtgcgacaccctcctgtgcgacatcggggagagctcccccaaccccaccatcgaggagggccgcacgctgcgggtgctcaagatggtggagccgtggctgcgcgggaaccagttctgcatcaagatcctgaacccctacatgcccagcgtcgtggagaccctcgagcagatgcagcggaagcacggcggcatgctggtgcgcaaccccctgtcccggaacagcacccacgagatgtactgggtctcctgcgggaccggcaacatcgtgagcgcggtgaacatgacctcccgcatgctcctgaaccggttcacgatggcccaccgcaagccgacctacgagcgcgacgtcgacctgggggccggcacccggcacgtggccgtggagcccgaggtcgccaacctcgacatcatcggccagcgcatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctgctgaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcgaagtggctctggggcttcctgtcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagcccgagcacgcgctgctggccaagtccatcttcaagctcacctaccagaacaaggtcgtgcgcgtgcagcggccggccaagaacgggaccgtcatggacgtgatcagccgccgcgaccagcggggctccggccaggtgggcacctacggcctgaacacgttcaccaacatggaggcccagctgatccgccagatggagagcgaggggatcttctcccccagcgagctcgagacccccaacctggccggccgggtcctggactggctcgagaagcacggggtggagcgcctgaagcggatggcgatctccggcgacgactgcgtggtcaagcccatcgacgaccgcttcgccaccgccctgacggccctcaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctggtggggcgcgcccgggtctcccagggcgcggggtggagcctccgcgagaccgcctgcctgggcaagtcctacgcccagatgtggcagctgatgtacttccaccggcgcgacctccggctggccgcgaacgccatctgcagcgccgtgccggtggactgggtccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccctacctcggcaagcgcgaggaccagtggtgcggcagcctgatcgggctgacggcccgggcgacctgggccaccaacatccaggtggccatcaaccaggtgcgccgcctcatcggcaacgagaactacctggactacatgacctccatgaagcggttcaagaacgagagcgacccggagggggccctgtggtga

SEQ ID NO: 8666 - RNA, 9879 nt, synthetic construct
  misc_feature 1..9879: note = derived and/or modified CDS sequence (opt1) from DENV-1__GU131759__SS-prME
  source 1..9879: mol_type = other RNA
agcgtgacgatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccttcacgttcatcaagaccaccttcagcctgcactacgcctggaagaccatggcgatggtcctctccatcgtgagcctgttccccctgtgcctctccacgaccagccagaagaccacctggctgcccgtgctgctcggctccctggggtgcaagccgctgacgatgttcctcatcgccgagaacaaggtctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggaccatgaagatcaaggacgaggagcgggacgacaccctcaccatcctgctgaaggccaccctcctggccgtgagcggcgtctacccgctgtccatccccgccaccctcttcgtgtggtacttctggcagaagaagaagcagcgcagcggggtgctgtgggacacccccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgcggtgctgatgtaccaggggaagcgcctggagccctcctgggccagcgtgaagaaggacctcatctcctacggcggcgggtggcggctgcagggcagctggaacacgggggaggaggtccaggtgatcgccgtggagcccggcaagaaccccaagaacgtccagaccgcccccgggaccttcaagacctccgagggcgaggtgggcgccatcgcgctggacttcaagcccgggacgagcggcagccccatcgtgaaccgcgaggggaagatcgtcggcctctacggcaacggggtggtgaccacctccggcacctacgtcagcgccatcgcccaggccaaggcgtcccaggaggggcccctgccggagatcgaggacgaggtgttccggaagcgcaacctgacgatcatggacctccaccccggcagcgggaagacccggcgctacctgcccgccatcgtgcgggaggccatcaagcgcaagctgcggaccctcatcctggccccgacccgcgtcgtggcctccgagatggcggaggccctgaagggcatgcccatccgctaccagacgaccgccgtcaagagcgagcacaccggcaaggagatcgtcgacctcatgtgccacgccaccttcacgatgcggctgctgtcccccgtgcgcgtgcccaactacaacatgatcatcatggacgaggcccacttcaccgacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccccgccggtgcctgaagccggtcatcctcaaggacgggcccgagcgcgtgatcctggccggccccatgcccgtcacggtggcctccgccgcgcagcggcgcgggcggatcggccgcaaccacaacaaggagggcgaccagtacatctacatggggcagccgctgaacaacgacgaggaccacgcccactggaccgaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtctggctcagccacaaggtggcctccgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagcccgaccgccagcggaccccgcaggacaaccagctcgcctacgtcgtgatcgggctgctgttcatgatcctcacggtggccgcgaacgagatgggcctgctggagaccaccaagaaggacctcgggatcggccacgccgccgtcgagaaccaccaccacgccgccatgctggacgtggacctgcaccccgcgtccgcctggaccctctacgccgtggccacgaccatcatcacccccatgatgcgccacaccatcgagaacacgaccgccaacatcagcctgaccgcgatcgccaaccaggccgccatcctgatggggctcgacaagggctggccgatctccaagatggacatcggcgtccccctgctggcgctcgggtgctacagccaggtgaaccccctgaccctgacggccgccgtgctcatgctggtcgcccactacgccatcatcggccccgggctgcaggcgaaggccacccgggaggcccagaagcgcaccgccgccggcatcatgaagaacccgaccgtggacgggatcgtggcgatcgacctcgaccccgtcgtgtacgacgccaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgccgtgagcatggcgaacatcttccgggggagctacctggccggcgccggcctcgccttctccctgatgaagtccctcgggggcgggcgccgggggaccggggcgcagggcgagaccctcggcgagaagtggaagcgccagctgaaccagctgtccaagagcgagttcaacacctacaagcggtccgggatcatggaggtcgaccgcagcgaggccaaggagggcctcaagcgcggggagacgaccaagcacgccgtgtcccgcggcaccgccaagctgcggtggttcgtggagcgcaacctggtcaagccggaggggaaggtgatcgacctcggctgcggccgcggcgggtggagctactactgcgccgggctgaagaaggtgaccgaggtcaaggggtacacgaagggcgggcccggccacgaggagcccatccccatggcgacctacgggtggaacctggtgaagctgcactccggcaaggacgtgttcttcatcccgcccgagaagtgcgacaccctcctgtgcgacatcggggagagctcccccaaccccaccatcgaggagggccgcacgctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgccgtgaacatgacctcccgcatgctcctgaaccggttcacgatggcccaccgcaagccgacctacgagcgcgacgtggacctgggggccggcacccggcacgtcgccgtggagcccgaggtggcgaacctcgacatcatcggccagcgcatcgagaacatcaagcacgagcacaagagcacctggcactacgacgaggacaacccctacaagacgtgggcctaccacgggtcctacgaggtcaagcccagcggcagcgcctccagcatggtgaacggggtcgtgaagctgctgaccaagccgtgggacgtgatccccatggtcacccagatcgccatgaccgacacgacccccttcggccagcagcgggtgttcaaggagaaggtggacacccgcacccccaaggccaagcgggggacggcgcagatcatggaggtcaccgccaagtggctctggggcttcctgtcccgcaacaagaagccgcggatctgcacccgcgaggagttcacccggaaggtgcgcagcaacgccgccatcggcgcggtgttcgtcgacgagaaccagtggaactccgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggcgaagatcacggacatcatggagcccgagcacgccctgctggccaagtccatcttcaagctcacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctgatccgccagatggagagcgaggggatcttctcccccagcgagctcgagacccccaacctggcgggccgggtgctggactggctcgagaagcacggggtcgagcgcctgaagcggatggccatctccggcgacgactgcgtggtgaagcccatcgacgaccgcttcgccaccgccctgacggccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcgcgggtgtcccagggcgccgggtggagcctccgcgagaccgcctgcctgggcaagtcctacgcccagatgtggcagctgatgtacttccaccggcgcgacctccggctggcggccaacgccatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgacggcgcgggccacctgggccaccaacatccaggtcgccatcaaccaggtgcgccgcctcatcggcaacgagaactacctggactacatgacctccatgaagcggttcaagaacgagagcgacccggagggggccctgtggtga

SEQ ID NO: 8667 - RNA, 9879 nt, synthetic construct
  misc_feature 1..9879: note = derived and/or modified CDS sequence (opt1) from DENV-1__GU131761__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatccaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtggagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8668 - RNA, 9879 nt, synthetic construct
  misc_feature 1..9879: note = derived and/or modified CDS sequence (opt1) from DENV-1__GU131762__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccatgagcctgtccatgacgtgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacctggacggagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacaccaccttcatcatcgacgggcccaacacgccggagtgccccgacgaccagcgcgcgtggaacatctgggaggtcgaggactacggcttcgggatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacgtggaagctcgcgcgggcctccttcatcgaggtcaagacctgcatctggcccaagagccacaccctgtggtccaacggcgtgctggagagcgagatgatcatccccaagatctacgggggcccgatctcccagcacaactaccgccccgggtacttcacccagacggccggcccctggcacctcgggaagctggagctggacttcgacctctgcgagggcaccaccgtggtcgtggacgagcactgcggcaaccgggggccgagcctgcgcaccacgaccgtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgacgggcaccctcgccgtgttcttcctgctgatcatggggcagctcacctggaacgacctgatccggctgtgcatcatggtcggcgcgaacgcctccgaccgcatggggatgggcaccacgtacctcgccctgatggccaccttcaagatgcgcccgatgttcgccgtgggcctcctgttccggcgcctgaccagccgggaggtgctgctcctgaccatcgggctgtccctcgtcgcgagcgtggagctgcccaactccctggaggagctcggcgacgggctggccatgggcatcatgatcctgaagctcctgacggacttccagagccaccagctgtgggccaccctcctgtccctgaccttcatcaagaccacgttcagcctccactacgcctggaagaccatggcgatggtcctgtccatcgtgagcctgttccccctctgcctgtccaccaccagccagaagacgacctggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacacgctgaccatcctgctcaaggccaccctgctggccgtgagcggcgtgtacccgctctccatccccgccaccctgttcctgtggtacttctggcagaagaagaagcagcgcagcggggtcctctgggacacccccagcccgcccgaggtggagcgggccgtgctggacgacggcatctaccgcatcatgcagcggggcctgctggggcgcagccaggtcggcgtgggggtgttccaggagaacgtcttccacacgatgtggcacgtgacccggggcgcggtgctcatgtaccaggggaagcgcctggagccctcctgggccagcgtcaagaaggacctgatctcctacggcggcgggtggcggctccagggcagctggaacaccggggaggaggtccaggtgatcgccgtcgagcccggcaagaaccccaagaacgtgcagaccgcccccgggacgttcaagacctccgagggcgaggtgggcgccatcgcgctggacttcaagcccgggaccagcggcagccccatcgtcaaccgcgaggggaagatcgtgggcctgtacggcaacggggtggtcaccacgtccggcacctacgtgagcgccatcgcccaggccaaggcgtcccaggaggggcccctcccggagatcgaggacgaggtgttccggaagcgcaacctgaccatcatggacctgcaccccggcagcgggaagacccggcgctacctccccgccatcgtccgggaggccatcaagcgcaagctgcggacgctgatcctcgccccgacccgcgtggtggcctccgagatggcggaggccctgaagggcatgcccatccgctaccagaccaccgccgtcaagagcgagcacacgggcaaggagatcgtggacctgatgtgccacgccaccttcaccatgcggctcctgtcccccgtgcgcgtccccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtggaggccttcccccagagcaacgccgtcatccaggacgaggagcgggacatcccggagcgctcctggaacagcgggtacgagtggatcaccgacttccccggcaagacggtgtggttcgtgccctccatcaagagcggcaacgacatcgccaactgcctgcggaagaacgggaagcgcgtcatccagctctcccggaagaccttcgacaccgagtaccagaagaccaagaacaacgactgggactacgtggtgacgaccgacatcagcgagatgggcgcgaacttccgcgccgaccgggtcatcgacccccgccggtgcctgaagccggtgatcctgaaggacgggcccgagcgcgtgatcctcgccggccccatgcccgtcaccgtggcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgggagaagtccgccgcgatcgacggggagtaccgcctgcgcggcgaggcccggaagaccttcgtcgagctcatgcgccgcggggacctgccggtgtggctgagctacaaggtggcctccgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcgtgtactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacacgatcgagaccctgatgctgctcgccctgatcgccgtgctgaccggcggggtcaccctcttcttcctgtccggccgggggctgggcaagacgagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcacccccatgatgcgccacacgatcgagaacaccaccgccaacatcagcctcaccgccatcgcgaaccaggccgccatcctgatggggctggacaagggctggccgatctccaagatggacatcggcgtccccctcctggccctggggtgctacagccaggtgaaccccctcacgctgaccgcggccgtgctgatgctcgtcgcccactacgccatcatcggccccgggctgcaggccaaggcgacccgggaggcccagaagcgcaccgccgccggcatcatgaagaacccgacggtggacgggatcgtggccatcgacctggaccccgtcgtgtacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtcccccggcaagttctggaacacgaccatcgccgtgagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggcgaaggagggcctgaagcgcggggagaccaccaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccacgatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggacgggcaacatcgtcagcgcggtgaacatgacctcccgcatgctgctcaaccggttcaccatggcccaccgcaagccgacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctcctgaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctctcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggccaagatcaccgacatcatggagcccgagcacgcgctcctggccaagtccatcttcaagctgacctaccagaacaaggtggtccgcgtgcagcggccggccaagaacgggaccgtgatggacgtcatcagccgccgcgaccagcggggctccggccaggtgggcacgtacggcctcaacaccttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccacggccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacctcccgcacgacctggagcatccacgcccaccaccagtggatgaccaccgaggacatgctgtccgtctggaaccgggtgtggatcgaggagaacccctggatggaggacaagacgcacatcagctcctggggcgacgtgccctacctgggcaagcgcgaggaccagtggtgcggcagcctcatcgggctgaccgcccgggcgacctgggccaccaacatccaggtcgccatcaaccaggtgcgccgcctgatcggcaacgagaactacctcgactacatgacgtccatgaagcggttcaagaacgagagcgacccggagggggccctgtggtga

SEQ ID NO: 8669 - RNA, 9879 nt, synthetic construct
  misc_feature 1..9879: note = derived and/or modified CDS sequence (opt1) from DENV-1__GU131763__SS-prME
  source 1..9879: mol_type = other RNA
agcgtgaccatgctgctcatgctgatgcccaccgccctggccttccacctcaccacccggggcggggagccccacatgatcgtgaccaagcaggagcgggggaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcctcggcgaggtcgacagcttctccctggggctgctctgcatcagcatcatgatcgaggaggtgatgcgctcccggtggagccgcaagatgctgatggccggcaccctggccgtgttcctcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccctcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggacgatgaagatcaaggacgaggagcgggacgacaccctgaccatcctcctgaaggccaccctgctcgccatcagcggcgtgtacccgctgtccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgcgaggggaagatcgtgggcctgtacggcaacggggtcgtgacgacctccggcacctacgtgagcgccatcgcccaggccaaggcgagccaggaggggccgctccccgagatcgaggacgaggtcttccggaagcgcaacctgaccatcatggacctgcaccccggctccgggaagacgcggcgctacctcccggccatcgtgcgggaggccatcaagcgcaagctgcggaccctgatcctcgcccccacccgcgtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcgcggcgaggcccggaagaccttcgtggagctcatgcgccgcggggacctgcccgtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccaccatgctcgacgtggacctgcaccccgccagcgcctggaccctgtacgcggtggccacgaccatcatcaccccgatgatgcgccacaccatcgagaacacgaccgccaacatctccctcaccgccatcgccaaccaggcggccatcctgatggggctggacaagggctggcccatcagcaagatggacatcggcgtccccctcctggccctggggtgctactcccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgagccagatcctgctgatgcgcaccacctgggcgctctgcgagtccatcaccctggccacgggccccctgaccaccctctgggaggggagcccgggcaagttctggaacaccacgatcgccgtgtccatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgagcaagtccgagttcaacatctacaagcggagcgggatcatggaggtcgaccgctccgaggccaaggagggcctgaagcgcggggagaccacgcgccacgcggtgagccggggcaccgccaagctgcgctggttcgtggagcggaacctcgtcaagcccgaggggaaggtgatcgacctgggctgcggccgcgggggctggtcctactactgcgccgggctgaagaaggtgaccgaggtcaagggctacaccaagggcgggcccggccacgaggagcccatcccgatggccacgtacgggtggaacctcgtgaagctgcacagcggcaaggacgtgttcttcacgccgcccgagcggtgcgacaccctgctctgcgacatcggggagtccagccccaacccgaccatcgaggagggccgcacgctgcgggtcctgaagatggtggagccctggctccgcgggaaccagttctgcatcaagatcctgaacccctacatgccctccgtggtcgagaccctggagcagatgcagcggaagcacggcggcatgctcgtgcgcaacccgctgagccggaactccacccacgagatgtactgggtgagctgcgggaccggcaacatcgtctccgccgtgaacatgaccagccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacgtgggcctaccacgggagctacgaggtcaagccgtccggcagcgcgtccagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcccgctggctgtggggcttcctcagccggaacaagaagccccgcatctgcacccgggaggagttcacccgcaaggtgcggtccaacgcggccatcggcgccgtgttcgtcgacgagaaccagtggaacagcgccaaggaggcggtggaggacgagcgcttctgggacctggtgcagaaggagcgggagctgcacaagcaggggaagtgcgccacgtgcgtctacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacccggatcaccgaggacgacctgcagaacgaggccaagatcacggacatcatggagccggagcacgccctcctggcgaccagcatcttcaagctgacctaccagaacaaggtggtccgcgtgcagcgccccgccaagaacgggaccgtgatggacgtcatctcccggcgcgaccagcggggcagcggccaggtgggcacgtacggcctcaacaccttcaccaacatggaggcccagctgatccgccagatggagtccgaggggatcttcctgcccagcgagctcgagacccccaacctggccgagcgggtgctggactggctcgagaagcacggcgtcgagcgcctgaagcggatggccatctccggggacgactgcgtggtgaagccgatcgacgaccgcttcgcgacggccctgaccgccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggccggctggtccctccgcgagaccgcgtgcctgggcaagagctacgcccagatgtggcagctgatgtacttccaccggcgcgacctccggctggccgccaacgcgatctgcagcgccgtccccgtggactgggtgcccacctcccgcacgacctggagcatccacgcccaccaccagtggatgaccaccgaggacatgctgtccgtctggaacaaggtgtggatcgaggagaacccctggatggaggacaagacgcacgtgagctcctggggcgacgtcccgtacctcgggaagcgggaggaccagtggtgcggcagcctgatcggcctgaccgcccgcgccacctgggcgtccaacatccaggtggccatcaaccaggtgcgccggctcatcgggaacgagaactacctggactacatgaccagcatgaagcgcttcaagaacgagggcgaccccgagggggccctgtggtga

SEQ ID NO: 8670 - RNA, 9879 nt, synthetic construct
  misc_feature 1..9879: note = derived and/or modified CDS sequence (opt1) from DENV-1__GU131766__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcatcgagcacggcaccaccgcgaccatcacgccccaggcccccacgtccgagatccagctcaccgactacggggccctgaccctggactgcagcccccgcaccggcctcgacttcaacgagatggtgctgctgacgatgaaggagaagtcctggctcgtccacaagcagtggttcctggacctgccgctcccctggaccagcggggccagcacctcccaggagacctggaaccggcaggacctgctggtgacgttcaagaccgcccacgcgaagaagcaggaggtggtcgtgctcggcagccaggagggcgccatgcacaccgccctgaccggggccacggagatccagacctccggcaccaccacgatcttcgccgggcacctgaagtgccgcctcaagatggacaagctgaccctgaagggcatgagctacgtgatgtgcaccgggtccttcaagctcgagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgatcgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacaccgcctgggacttcgggtccatcggcggcgtgttcaccagcatcgggaagctggtgcaccagatcttcggcacggcctacggggtcctcttctccggcgtgagctggaccatgaagatcgggatcggcgtgctgctgacctggctcggcctgaactcccgcagcacctccctgagcatgacgtgcatcgccgtcgggctcgtgaccctgtacctgggcgtgatggtccaggccgactccgggtgcgtgatcaactggaagggccgggagctcaagtgcgggagcggcatcttcgtgaccaacgaggtccacacctggacggagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagatgcgggacagctacacccaggtctgcgaccaccgcctgatgtccgcggccatcaaggacagcaaggccgtgcacgccgacatgggctactggatcgagtccgagaagaacgagacgtggaagctcgcccgggcgagcttcatcgaggtgaagacctgcatctggcccaagtcccacaccctgtggagcaacggcgtcctggagtccgagatgatcatccccaagatctacgggggcccgatcagccagcacaactaccgccccgggtacttcacccagacggccggcccctggcacctcgggaagctggagctggacttcgacctctgcgagggcaccaccgtggtggtcgacgagcactgcggcaaccgggggccgtccctgcgcaccacgaccgtgaccggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgacgggcaccctcgccgtgttcctgctgctcatcatggggcagctgacctggaacgacctgatccggctctgcatcatggtgggcgccaacgcgagcgaccgcatggggatgggcaccacgtacctggccctgatggccaccttcaagatgcgcccgatgttcgccgtcgggctcctgttccggcgcctgacctcccgggaggtgctcctgctgaccatcgggctcagcctggtggcctccgtcgagctgcccaacagcctcgaggagctgggcgacgggctggcgatgggcatcatgatcctcaagctgctgacggacttccagtcccaccagctctgcgccaccctgctgagcctcaccttcatcaagaccacgctgtccctgcactacgcctggaagaccatggccatggtgctcagcatcgtctccctgatccccctgtgcctcagcaccacctcccagaagacgacctggctgcccgtgctgctcggcagcctggggtgcaagccgctgaccatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacacgctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacacgatgtggcacgtgacccggggcgccgtcctgatgtaccaggggaagcgcctggagcccagctgggcgtccgtgaagaaggacctcatcagctacggcggcgggtggcggctgcagggctcctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggaccagcggctcccccatcgtgaaccgcgaggggaagatcgtgggcctctacggcaacggggtcgtgaccacgagcggcacctacgtgagcgcgatcgcccaggccaaggcctcccaggaggggccgctgcccgagatcgaggacgaggtcttccggaagcgcaacctgaccatcatggacctccaccccggcagcgggaagacccggcgctacctgccggcgatcgtgcgggaggccatcaagcgcaagctgcggacgctcatcctggcccccacccgcgtggtcgcctccgagatggccgaggcgctgaagggcatgcccatccgctaccagaccaccgccgtcaagagcgagcacacgggcaaggagatcgtggacctcatgtgccacgccaccttcaccatgcggctgctgtcccccgtccgcgtgccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagacggtgtggttcgtcccctccatcaagagcggcaacgacatcgccaactgcctccggaagaacgggaagcgcgtgatccagctgtcccggaagaccttcgacaccgagtaccagaagaccaagaacaacgactgggactacgtggtcacgaccgacatcagcgagatgggcgccaacttccgcgcggaccgggtgatcgacccgcgccggtgcctgaagcccgtgatcctcaaggacgggcccgagcgcgtcatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacgcagcgcgcccagaacgccctggacaacctggtgatgctccacaacagcgagcagggcgggcgggcctaccgccacgcgatggaggagctgcccgacaccatcgagaccctgatgctcctggccctgatcgccgtgctcaccggcggggtcacgctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccacgaagaaggacctcgggatcggccacgtggcggtcgagaaccaccaccacgccaccatgctggacgtggacctgcaccccgcctccgcctggaccctctacgccgtggcgaccacgatcatcaccccgatgatgcgccacaccatcgagaacaccacggccaacatcagcctgaccgccatcgccaaccaggccgcgatcctgatggggctcgacaagggctggcccatctccaagatggacatcggcgtccccctgctggccctcgggtgctacagccaggtgaaccccctgaccctgaccgccgccgtgctcatgctggtcgcgcactacgccatcatcggcccggggctgcaggccaaggccacgcgggaggcccagaagcgcaccgcggccggcatcatgaagaaccccaccgtggacgggatcgtggccatcgacctcgaccccgtcgtgtacgacgccaagttcgagaagcagctgggccagatcatgctgctcatcctgtgcacctcccagatcctgctcatgcgcacgacctgggccctgtgcgagagcatcaccctggcgaccggccccctcacgaccctgtgggaggggtccccgggcaagttctggaacaccaccatcgccgtgagcatggccaacatcttccgggggtcctacctggccggcgccggcctcgcgttcagcctgatgaagtccctcgggggcgggcgccgggggacgggggcccagggcgagaccctcggcgagaagtggaagcgccagctgaaccagctgtccaagagcgagttcaacatctacaagcggtccgggatcatggaggtcgaccgcagcgaggccaaggagggcctcaagcgcggggagaccacccgccacgccgtgtcccggggcacggcgaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacctacgggtggaacctggtgaagctgcactccggcaaggacgtgttcttcacgccgcccgagaagtgcgacaccctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagacgctcgagcagatgcagcgcaagcacggcggcatgctggtgcggaacccgctgtcccgcaacagcacccacgagatgtactgggtgtcctgcgggaccggcaacatcgtcagcgccgtgaacatgacctcccggatgctcctgaaccgcttcaccatggcccaccgcaagcccacgtacgagaaggacgtggacctgggggcgggcacccggcacgtcgccgtggagcccgaggtggccaacctcgacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctgacgaagccctgggacgtgatccccatggtcacccagatcgcgatgaccgacaccacgcccttcggccagcagcgggtgttcaaggagaaggtggacacccgcaccccgaaggccaagcgggggaccgtccagatcatggaggtgacggcccgctggctctggggcttcctgtcccggaacaagaagccccgcatctgcacccgggaggagttcacccgcaaggtgcggagcaacgccgccatcggcgcggtcttcgtggacgagaaccagtggaactccgccaaggaggccgtggaggacgagcgcttctgggacctggtcaagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggcgggctgggacacccggatcaccgaggacgacctccagaacgaggccaagatcaccgacatcatggagccggagcacgccctgctggccacgtccatcttcaagctcacctaccagaacaaggtcgtgcgcgtgcagcggcccgccaagaacgggaccgtcatggacgtgatcagccgccgcgaccagcggggctccggccaggtgggcacctacggcctgaacacgttcaccaacatggaggcgcagctgatccgccagatggagagcgaggggatcttcctcccctccgagctggagacccccaacctggccgagcgggtcctcgactggctggagaagtacggcgtggagcgcctgaagcggatggccatcagcggggacgactgcgtggtcaagccgatcgacgaccgcttcgccaccgccctcacggcgctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcccgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccaccagccgcaccacgtggtccatccacgcgcaccaccagtggatgaccaccgaggacatgctcagcgtgtggaaccgggtgtggatcgaggagaacccctggatggaggacaagacccacgtctccagctggggcgacgtgccgtacctggggaagcgcgaggaccagtggtgcggctccctgatcggcctcacggcccgggccacctgggccagcaacatccaggtggccatcaaccaggtccgccgcctgatcgggaacgagaactacctggactacatgacctccatgaagcggttcaagaacgagggcgaccccgagggggcgctctggtga

SEQ ID NO: 8671 - RNA, 9879 nt, synthetic construct
  misc_feature 1..9879: note = derived and/or modified CDS sequence (opt1) from DENV-1__GU131767__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgtgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtcggcctcgggctggagacgcgcaccgagacctggatgagctccgagggcgcctggaagcagatccagcgggtggagacctgggccctgcgccaccccgggttcacggtgatcgccctcttcctggcccacgcgatcggcaccagcatcacccagaaggggatcatcttcatcctgctcatgctggtcaccccctccatggccatgcggtgcgtgggcatcggcagccgcgacttcgtggaggggctgtccggcgccacgtgggtcgacgtggtgctcgagcacgggagctgcgtcaccaccatggccaaggacaagcccaccctggacatcgagctgctcaagacggaggtgaccaaccccgccgtgctgcggaagctgtgcatcgaggcgaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatcacgtgcgccaagttcaagtgcgtcaccaagctcgagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccagcacggagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggaccagcggggcctccaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctcgtgcagatcaagtacgagggcaccgacgcgccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgccggcgagaaggcgctgaagctgtcctggttcaagaaggggagctccatcggcaagatgttcgaggccaccgcccgcggggcccggcgcatggccatcctcggcgacaccgcgtgggacttcgggagcatcggcggcgtcttcacgtccgtggggaagctggtgcaccagatcttcggcaccgcctacggggtcctgttcagcggcgtgtcctggaccatgaagatcgggatcggcgtgctcctgacctggctgggcctcaacagccgctccacgagcctgtccatgacctgcatcgccgtcgggctggtgaccctctacctgggcgtgatggtccgggccgacagcgggtgcgtgatcaactggaagggccgcgagctgaagtgcgggagcggcatcttcgtgaccaacgaggtccacacgtggaccgagcagtacaagttccaggccgactccccgaagcggctcagcgcggccatcggcaaggcctgggaggagggggtgtgcggcatccgctccgccacccggctggagaacatcatgtggaagcagatcagcaacgagctgaaccacatcctcctggagaacgacatgaagctgaccgtggtcgtgggggacgtggccggcatcctcgcgcaggggaagaagatgatccgcccccagcccatggagtacaagtactcctggaagtcctggggcaaggccaagatcatcggcgccgacgtccagaacaccacgttcatcatcgacgggcccaacaccccggagtgccccgacgaccagcgggcctggaacatctgggaggtggaggactacggcttcgggatcttcaccaccaacatctggctgaagctgcgcgactcctacacccaggtgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcatctggcccaagagccacaccctgtggtccaacggcgtgctcgagagcgagatgatcatccccaagatctacgggggcccgatctcccagcacaactaccggcccgggtacttcacgcagaccgccggcccctggcacctggggaagctggagctcgacttcgacctgtgcgagggcaccaccgtcgtggtggacgagcactgcggcaaccgcgggccgagcctgcggacgaccaccgtcaccggcaagatcatccacgagtggtgctgccgctcctgcacgctgccgcccctccggttcaagggggaggacggctgctggtacgggatggagatccgccccgtgaaggagaaggaggagaacctggtcaagagcatggtcagcgccggctccggcgaggtggacagcttctccctcgggctgctgtgcatcagcatcatgatcgaggaggtgatgcggtcccgctggagccggaagatgctcatgaccggcaccctggccgtcttcttcctgctcatcatggggcagctgacctggaacgacctgatccgcctctgcatcatggtgggcgccaacgcgtccgaccgcatggggatgggcacgacctacctggccctgatggccaccttcaagatgcggccgatgttcgccgtgggcctcctgttccgccggctgaccagccgcgaggtcctcctgctgacgatcgggctctccctggtggccagcgtcgagctgcccaactccctcgaggagctgggcgacgggctggcgatgggcatcatgatcctcaagctgctgaccgacttccagagccaccagctctgggccaccctgctgtccctcaccttcatccggacgaccttcagcctgcactacgcctggaagaccatggccatggtgctgtccatcgtgagcctcttccccctgtgcctgtccaccacgagccagaagaccacctggctccccgtcctgctgggctccctcgggtgcaagccgctgaccatgttcctgatcgcggagaacaagatctggggccgcaagagctggcccctcaacgaggggatcatggccgtgggcatcgtgagcatcctgctgtccagcctcctgaagaacgacgtccccctggccgggcccctcatcgccggcggcatgctgatcgcctgctacgtgatctccgggagctccgcggacctgagcctcgagaaggccgccgtggtctcctgggaggaggaggccgagcacagcggcgcctcccacaacatcctggtggaggtgcaggacgacgggacgatgaagatcaaggacgaggagcgggacgacaccctgaccatcctcctgaaggcgaccctgctcgccgtcagcggcgtgtacccgctgtccatccccgccaccctgttcgtgtggtacttctggcagaagaagaagcagcgcagcggggtcctctgggacacgcccagcccgcccgaggtggagcgggccgtgctggacgacggcatctaccgcatcatgcagcggggcctgctggggcgcagccaggtcggcgtgggggtgttccaggagaacgtcttccacaccatgtggcacgtgacccggggcgccgtgctcatgtaccaggggaagcgcctggagccctcctgggcgagcgtcaagaaggacctgatctcctacggcggcgggtggcggctccagggcagctggaacaccggggaggaggtccaggtgatcgccgtcgagcccggcaagaaccccaagaacgtgcagacggcccccgggaccttcaagacctccgagggcgaggtgggcgccatcgccctggacttcaagcccgggaccagcggcagccccatcgtcaaccgcgaggggaagatcgtgggcctgtacggcaacggggtggtcacgacctccggcacctacgtgagcgcgatcgcccaggccaaggcctcccaggaggggcccctcccggagatcgaggacgaggtgttccggaagcgcaacctgaccatcatggacctgcaccccggcagcgggaagacgcggcgctacctccccgcgatcgtccgggaggccatcaagcgcaagctgcgcaccctgatcctcgccccgacccgggtggtggcctccgagatggccgaggcgctgaagggcatgcccatccgctaccagaccacggccgtcaagagcgagcacaccggcaaggagatcgtggacctgatgtgccacgccaccttcaccatgcggctcctgtcccccgtgcgcgtccccaactacaacatgatcatcatggacgaggcccacttcacggacccgagctccatcgccgcgcgggggtacatcagcacccgcgtgggcatgggggaggccgccgccatcttcatgaccgccacgccgcccggctccgtggaggcgttcccccagagcaacgccgtcatccaggacgaggagcgggacatcccggagcgctcctggaacagcgggtacgagtggatcacggacttccccggcaagaccgtgtggttcgtgccctccatcaagagcggcaacgacatcgccaactgcctgcggaagaacgggaagcgcgtcatccagctctcccggaagaccttcgacaccgagtaccagaagacgaagaacaacgactgggactacgtggtgaccaccgacatcagcgagatgggcgccaacttccgcgcggaccgggtcatcgacccccgccggtgcctgaagccggtgatcctgaaggacgggcccgagcgcgtcatcctcgccggccccatgcccgtgaccgtggcctccgccgcccagcggcgcgggcggatcggccgcaaccacaacaaggagggcgaccagtacatctacatggggcagccgctgaacaacgacgaggaccacgcgcactggacggaggccaagatgctgctcgacaacatcaacacccccgagggcatcatccccgccctgttcgagcccgagcgcgagaagtccgccgccatcgacggggagtaccggctgcgcggcgaggcgcggaagaccttcgtcgagctcatgcgccgcggggacctgccggtgtggctgagctacaaggtggcctccgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacgtactccgaccccctcgccctgcgggagttcaaggagttcgccgcgggccgccggagcgtgtccggggacctgatcctcgagatcggcaagctgccccagcacctgacccagcgcgcccagaacgccctcgacaacctggtcatgctgcacaacagcgagcagggcgggcgggcctaccgccacgcgatggaggagctcccggacaccatcgagaccctgatgctgctcgccctgatcgccgtgctgacgggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagcccgaccgccagcggaccccgcaggacaaccagctggcctacgtggtgatcgggctcctgttcatgatcctgaccgtcgccgccaacgagatgggcctcctggagacgaccaagaaggacctggggatcggccacgtggcggtggagaaccaccaccacgccgccatgctcgacgtcgacctgcaccccgcctccgcctggaccctgtacgcggtggccaccacgatcatcacccccatgatgcgccacaccatcgagaacaccacggccaacatcagcctcaccgccatcgccaaccaggcggccatcctgatggggctggacaagggctggccgatctccaagatggacatcggcgtgcccctcctggccctggggtgctacagccaggtcaaccccctcaccctgaccgccgcggtgctgatgctcgtggcccactacgccatcatcggccccgggctgcaggccaaggccacgcgcgaggcgcagaagcggaccgccgccggcatcatgaagaacccgaccgtcgacgggatcgtggccatcgacctggaccccgtggtctacgacgccaagttcgagaagcagctcggccagatcatgctgctgatcctctgcacctcccagatcctgctgatgcgcacgacctgggcgctctgcgagagcatcaccctggccaccggccccctgacgaccctctgggaggggtcccccggcaagttctggaacaccaccatcgccgtgagcatggccaacatcttccgggggagctacctggccggcgcgggcctggccttctccctcatgaagtccctcgggggcgggcgccgggggacgggggcccagggcgagaccctgggcgagaagtggaagcgccagctcaaccagctgtccaagagcgagttcaacacctacaagcggtccgggatcatggaggtggaccgcagcgaggccaaggagggcctgaagcgcggggagaccacgaagcacgcggtctcccgcggcaccgccaagctccggtggttcgtggagcgcaacctggtgaagccggaggggaaggtcatcgacctgggctgcggccgcggcgggtggagctactactgcgccgggctgaagaaggtgaccgaggtgaaggggtacaccaagggcggccccggccacgaggagcccatccccatggccacgtacgggtggaacctcgtcaagctgcactccggcaaggacgtgttcttcatcccgcccgagaagtgcgacaccctgctctgcgacatcggggagagctcccccaaccccaccatcgaggagggccgcaccctgcgggtgctgaagatggtcgagccgtggctccgcgggaaccagttctgcatcaagatcctgaacccctacatgcccagcgtggtggagacgctggagcagatgcagcggaagcacggcggcatgctcgtccgcaaccccctgtcccggaacagcacccacgagatgtactgggtgtcctgcgggaccggcaacatcgtgagcgccgtcaacatgacctcccgcatgctgctcaaccgcttcaccatggcgcaccggaagccgacgtacgagcgcgacgtggacctgggggccggcacccggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtcaagcccagcggcagcgcgtccagcatggtgaacggggtggtcaagctcctgacgaagccgtgggacgtgatccccatggtgacccagatcgccatgaccgacaccacgcccttcggccagcagcgggtcttcaaggagaaggtggacacccgcacccccaaggccaagcgggggaccgcccagatcatggaggtgacggccaagtggctgtggggcttcctctcccgcaacaagaagccgcggatctgcacccgcgaggagttcacccggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacacggccggctgggacacccggatcaccgaggacgacctgcagaacgaggccaagatcaccgacatcatggagcccgagcacgccctcctggcgaagtccatcttcaagctgacgtaccagaacaaggtggtgcgcgtccagcgcccggccaagaacgggaccgtgatggacgtgatcagccggcgcgaccagcggggctccgggcaggtcggcacctacggcctcaacaccttcacgaacatggaggcccagctgatccgccagatggagagcgaggggatcttctcccccagcgagctggagacccccaacctcgccggccgggtgctggactggctggagaagcacggggtggagcgcctcaagcggatggccatctccggcgacgactgcgtcgtgaagcccatcgacgaccgcttcgcgaccgccctgaccgccctgaacgacatggggaaggtgcggaaggacatcccgcagtgggagcccagcaagggctggaacgactggcagcaggtccccttctgcagccaccacttccaccagctcatcatgaaggacggccgcgagatcgtggtgccctgccggaaccaggacgagctggtcgggcgcgcccgggtgtcccagggcgccgggtggagcctgcgcgagacggcgtgcctcggcaagtcctacgcccagatgtggcagctgatgtacttccaccggcgcgacctgcggctcgccgccaacgcgatctgcagcgccgtgccggtcgactgggtgcccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccctacctgggcaagcgcgaggaccagtggtgcggcagcctcatcgggctgaccgcccgcgccacgtgggcgaccaacatccaggtggccatcaaccaggtccggcgcctgctcggcaacgagaactacctggactacatgacctccatgaagcggttcaagaacgagagcgacccggagggggccctgtggtga

SEQ ID NO: 8672 - RNA, 9879 nt, synthetic construct
  misc_feature 1..9879: note = derived and/or modified CDS sequence (opt1) from DENV-1__HM181967__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacatggccgtggagaaccaccaccacgccgccatgctcgacgtcgacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtcaaccccctcaccctgacggcggccgtgctgatgctcgtggcccactacgccatcatcggcccggggctgcaggccaaggcgacccgggaggcccagaagcgcaccgccgccggcatcatgaagaaccccaccgtcgacgggatcgtggccatcgacctggaccccgtggtctacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagacgaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgaccgaggtgaagggctacacgaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgaccatcgaggagggccggacgctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacctcccgcatgctgctcaaccggttcacgatggcccaccgcaagcccacctacgagcgggacgtggacctgggggccggcacccgccacgtggccgtcgagcccgaggtggccaacctggacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtcaagctcctgaccaagccctgggacgtgatccccatggtgacccagatcgccatgaccgacacgacccccttcggccagcagcgcgtcttcaaggagaaggtggacacccggaccccgaaggccaagcgcgggacggcccagatcatggaggtgaccgcgaagtggctgtggggcttcctctcccggaacaagaagccccgcatctgcacccgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtgcgggtccagcgccccgccaagaacgggaccgtgatggacgtgatcagccggcgcgaccagcggggctccgggcaggtcggcacctacggcctcaacacgttcaccaacatggaggcccagctgatccgccagatggagagcgaggggatcttctcccccagcgagctggagacccccaacctcgccgagcgggtgctggactggctggagaagtacggcgtggagcgcctcaagcggatggcgatctccggggacgactgcgtcgtgaagccgatcgacgaccgcttcgccaccgccctgacggccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtcgactggatccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctggggaagcgggaggaccagtggtgcggcagcctcatcggcctgacggcccgcgcgacctgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8673 - RNA, 9879 nt, synthetic construct
  misc_feature 1..9879: note = derived and/or modified CDS sequence (opt1) from DENV-1__GU131768__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcaactggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtcatgctgcacaacagcgagcagggcgggcgggcctaccgccacgccatggaggagctgcccgacacgatcgagaccctcatgctgctggcgctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgccgcgagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccaccaagaaggacctggggatcggccacgtggccgtggagaaccaccaccacgcgacgatgctggacgtcgacctccaccccgcctccgcctggaccctgtacgccgtggccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtcaaccccctgaccctcaccgccgccgtgctgatgctggtggcccactacgcgatcatcggcccggggctccaggccaaggccacccgggaggcccagaagcgcacggccgcgggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtgagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcaccgccaagctgcgctggttcgtggagcggaacctggtgaagcccgaggggaaggtcatcgacctcggctgcggccgcgggggctggagctactactgcgcggggctgaagaaggtgacggaggtgaagggctacaccaagggcgggcccggccacgaggagcccatcccgatggccacctacgggtggaacctggtcaagctccactccggcaaggacgtgttcttcacgccgcccgagaagtgcgacacgctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggacgggcaacatcgtgagcgccgtcaacatgacctcccggatgctgctgaaccgcttcaccatggcccaccgcaagcccacctacgagcgggacgtggacctcggggccggcacgcgccacgtggcggtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcaccaagccctgggacgtgatccccatggtgacgcagatcgccatgaccgacaccacccccttcggccagcagcgcgtcttcaaggagaaggtggacacgcggaccccgaaggcgaagcgcgggaccgcccagatcatggaggtgaccgcccggtggctgtggggcttcctgtcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctcgtgaagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgcgggctgggacacgcgcatcaccgccgacgacctgcagaacgaggccaagatcaccgacatcatggagccggagcacgccctgctcgccacctccatcttcaagctgacgtaccagaacaaggtggtgcgggtccagcgccccgcgaagaacgggaccgtgatggacgtgatcagccgccgggaccagcgcggctccgggcaggtcggcacctacggcctgaacaccttcacgaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagacggcctgcctcggcaagagctacgcgcagatgtggcagctgatgtacttccaccgccgggacctgcgcctcgccgccaacgccatctgctccgcggtgcccgtcgactgggtgcccaccagccggaccacctggtccatccacgcccaccaccagtggatgacgaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacgtccatgaagcgcttcaagaacgagggcgaccccgagggggccctgtggtga

SEQ ID NO: 8674 - RNA, 9879 nt, synthetic construct
  misc_feature 1..9879: note = derived and/or modified CDS sequence (opt1) from DENV-1__GU131770__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatccgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactgcgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggacaagcagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcggcgggtggagctactactgcgccgggctgaagaaggtgacggaggtcaaggggtacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacgggaccgtgatggacgtcatcagccgccgggaccagcgcggctccggccaggtgggcacgtacggcctcaacaccttcaccaacatggaggcccagctgatccggcagatggagagcgaggggatcttctcccccagcgagctggagacccccaacctcgccgagcgcgtgctggactggctggagaagtacggcgtcgagcggctcaagcgcatggccatctccggggacgactgcgtggtgaagccgatcgacgaccggttcgcgacggccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgcgaggaccagtggtgcggcagcctcatcggcctgaccgcccgggccacctgggcgaccaacatccaggtggccatcaaccaggtccgccggctgatcgggaacgagaactacctcgactacatgacctccatgaagcgcttcaagaacgagagcgaccccgagggcgccctgtggtga

SEQ ID NO: 8675 - RNA, 9879 nt, synthetic construct
  misc_feature 1..9879: note = derived and/or modified CDS sequence (opt1) from DENV-1__GU131773__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgagaagcggtccgtggccctcgcgccccacgtgggcctggggctggagacgcggaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcatgaccaagctggagggcaagatcgtgcagtacgagaacctcaagtacagcgtcatcgtgaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtccacaagcagtggttcctggacctccccctgccctggaccagcggggccagcacctcccaggagacgtggaaccggcaggacctgctcgtgaccttcaagaccgcccacgcgaagaagcaggaggtggtcgtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtgatgtgcaccgggtccttcaagctggagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggtgcaggggaagaagatgatccggccccagcccatggagtacaagtacagctggaagtcctggggcaaggccaagatcatcggcgccgacgtgcagaacagcacgttcatcatcgacgggcccaacaccccggagtgccccgacgaccagcgcgcctggaacatctgggaggtcgaggactacggcttcgggatcttcaccaccaacatctggctgaagctccgggactcctacacccaggtgtgcgaccaccgcctgatgagcgcggccatcaaggactccaaggccgtgcacgccgacatgggctactggatcgagagcgagaagaacgagacctggaagctggcccgggcgtccttcatcgaggtcaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtggtcgtggacgagcactgcggcaaccgggggccgagcctccgcacgaccaccgtgaccggcaagatcatccacgagtggtgctgccggtcctgcacgctgccgcccctgcgcttccgcggggaggacggctgctggtacgggatggagatccgccccgtcaaggagaaggaggagaacctcgtcaagagcatggtgagcgccggctccggcgaggtcgacagcttcctgctggggctcctgtgcatctccatcatgatcgaggaggtgatgcggagccgctggtcccggaagatgctgatgaccggcaccctcgccgtgttcttcctgctgatcatggggcagctcacctggaacgacctgatccgcctgtgcatcatggtcggcgccaacgcgagcgaccgcatggggatgggcacgacctacctcgccctgatggccaccttcaagatgcggccgatgttcgccgtgggcctgctgttccgccggctgacctcccgcgaggtgctgctcctgacgatcgggctgagcctcgtcgcctccgtggagctgcccaacagcctggaggagctcggcgacgggctggcgatgggcatcatgatcctgaagctcctgaccgacttccagtcctaccagctgtgggccaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgcggagaacaagatctggggccggaagtcctggcccctgaacgaggggatcatggccgtcggcatcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggacgatgaagatcaaggacgaggagcgcgacgacaccctgaccatcctgctcaaggcgaccctgctggccgtgtccggcgtgtacccgctcagcatccccgccaccctgttcgtctggcacttctggcagaagaagaagcagcggtccggggtgctgtgggacacgcccagcccgcccgaggtggagcgcgccgtcctggacgacggcatctaccggatcatgcagcgcggcctcctggggcggtcccaggtgggcgtgggggtcttccaggagaacgtgttccacaccatgtggcacgtgacccgcggcgccgtcctgatgtaccaggggaagcggctcgagcccagctgggcgtccgtgaagaaggacctgatcagctacggcggcgggtggcgcttccagggctcctggaacaccggggaggaggtgcaggtcatcgccgtggagcccggcaagaaccccaagaacgtgcagacggcccccgggaccttcaagacccccgagggcgaggtcggcgccatcgccctggacttcaagcccgggaccagcggctcccccatcgtgaaccgggaggggaagatcgtgggcctctacggcaacggggtcgtgacgaccagcggcacctacgtgagcgcgatcgcccaggccaaggcctcccaggaggggccgctgcccgagatcgaggacgaggtcttccgcaagcggaacctgaccatcatggacctccaccccggcagcgggaagacgcgccggtacctgccggcgatcgtgcgcgaggccatcaagcggaagctgcgcaccctcatcctggcccccacccgcgtggtcgcctccgagatggccgaggcgctgaagggcatgcccatccggtaccagaccacggccgtcaagagcgagcacaccggcaaggagatcgtggacctcatgtgccacgccaccttcaccatgcgcctgctgtcccccgtccgggtgccgaactacaacatgatcatcatggacgaggcccacttcacggaccccagctccatcgccgcgcgcgggtacatcagcacccgggtgggcatgggggaggccgccgccatcttcatgaccgccacgccgcccggctccatggaggcgttcccgcagagcaacgccgtcatccaggacgaggagcgcgacatccccgagcggtcctggaacagcgggtacgagtggatcacggacttccccggcaagaccgtgtggttcgtgccctccatcaaggccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgcgaacttccgggccgaccgcgtcatcgacccgcggcgctgcctgaagcccgtgatcctcaaggacgggcccgagcgggtgatcctggccggccccatgccggtcaccgtggccagcgccgcgcagcgccgggggcgcatcggccggaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccgcctccggggcgaggcccgcaagaccttcgtcgagctgatgcggcgcggggacctgcccgtgtggctcagctacaaggtggcctccgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgcggccggccggcgctccgtgagcggggacctcatcctggagatcggcaagctgccgcagcacctcacccagcgggcccagaacgccctggacaacctggtcatgctccacaactccgagcagggcgggcgcgcgtaccggcacgccatggaggagctgcccgacaccatcgagaccctgatgctcctggccctgatcgccgtgctcacgggcggggtgaccctgttcttcctgagcggcaaggggctcggcaagacctccatcggcctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcgggctgctgttcatgatcctcaccgtcgccgcgaacgagatgggcctgctggagacgaccaagaaggacctcgggatcggccacgtggccgtggagaaccaccaccacgccgccatgctggacgtcgacctgcaccccgccagcgcgtggaccctctacgccgtggccaccacgatcatcaccccgatgatgcgccacaccatcgagaacaccacggccaacatctccctgaccgccatcgcgaaccaggccgccatcctgatggggctcgacaagggctggcccatcagcaagatggacatcggcgtgcccctgctggccctcgggtgctactcccaggtcaaccccctgaccctgaccgcggccgtgctcatgctggtggcccactacgccatcatcggcccggggctgcaggccaaggcgacgcgggaggcccagaagcgcaccgccgccggcatcatgaagaaccccaccatcgacgggatcgtcgccatcgacctcgaccccgtggtgtacgacgcgaagttcgagaagcagctgggccagatcatgctgctcatcctgtgcaccagccagatcctgctcatgcgcacgacctgggccctgtgcgagtccatcaccctggccaccggccccctcacgaccctgtgggaggggagcccgggcaagttctggaacaccaccatcgccgtctccatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgagcaagtccgagttcaacacctacaagcggagcgggatcatggaggtggaccgctccgaggcgaaggagggcctcaagcgcggggagaccacgaagcacgccgtgagccgcggcaccgccaagctgcggtggttcgtcgagcgcaacctggtgaagcccgaggggaaggtgatcgacctgggctgcggccgcgggggctggtcctactactgcgccgggctcaagaaggtcaccgaggtgaagggctacaccaagggcggccccggccacgaggagcccatcccgatggccacgtacgggtggaacctggtgaagctgcacagcggcaaggacgtcttcttcatcccgcccgagaagtgcgacaccctcctgtgcgacatcggggagtccagccccaacccgaccatcgaggagggccgcaccctgcgggtgctcaagatggtggagccctggctgcgcgggaaccagttctgcatcaagatcctgaacccctacatgccctccgtcgtggagacgctcgagcagatgcagcggaagcacggcggcatgctggtgcgcaacccgctgagccggaactccacccacgagatgtactgggtcagctgcgggaccggcaacatcgtgtccgcggtgaacatgaccagccgcatgctcctgaaccggttcaccatggcccaccgcaagcccacgtacgagcgcgacgtcgacctgggggccggcacccggcacgtggccgtggagcccgaggtcgccaacctcgacatcatcggccagcgcatcgagaacatcaagcacgagcacaagtccacctggcactacgacgaggacaacccctacaagacctgggcgtaccacgggagctacgaggtgaagccgtccggcagcgcctccagcatggtgaacggggtcgtgaagctgctgacgaagccctgggacgtcatccccatggtgacccagatcgccatgaccgacaccacgcccttcggccagcagcgggtgttcaaggagaaggtcgacacccgcaccccgaaggccaagcgggggaccgcccagatcatggaggtgacggcgcgctggctctggggcttcctgagccggaacaagaagccccgcatctgcacccgggaggagttcacccgcaaggtgcggtccaacgccgccatcggcgccgtcttcgtggacgagaaccagtggaacagcgcgaaggaggccgtggaggacgaccgcttctgggacctggtccaccgggagcgcgagctccacaagcaggggaagtgcgcgacctgcgtgtacaacatgatgggcaagcgggagaagaagctgggggagttcggcaaggccaaggggtcccgcgccatctggtacatgtggctgggcgcgcggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacacggccggctgggacacccgcatcaccgaggacgacctccagaacgaggccaagatcaccgacatcatggagccggagcacgcgctgctggccaagagcatcttcaagctcacgtaccagaacaaggtcgtgcgggtgcagcgccccgccaagaacgggaccgtcatggacgtgatctcccgccgggaccagcgcggcagcggccaggtggggacctacggcctgaacaccttcacgaacatggaggcccagctgatccggcagatggagtccgaggggatcttcctccccaacgagctggagacccccaacctggccggccgcgtcctcgactggctggagaagtacggggtggagcggctgaagcgcatggcgatcagcggcgacgactgcgtggtcaagccgatcgacgaccggttcgccaccgccctcaccgccctgaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctcgtggggcgggcccgcgtctcccagggcgcggggtggagcctgcgggagacggcctgcctgggcaagtcctacgcccagatgtggcagctcatgtacttccaccgccgggacctgcgcctggccgcgaacgccatctgcagcgccgtgcccgtggactgggtccccaccagccggaccacctggtccatccacgcccaccaccagtggatgacgaccgaggacatgctcagcgtgtggaaccgcgtgtggatcgaggagaacccctggatggaggacaagacccggatctccagctgggaggacgtcccgtacctggggaagcgcgaggaccagtggtgcggctccctgatcggcctcaccgcccgcgcgacgtgggccaccaacatccaggtggccatcaaccaggtgcggcgcctgatcgggaacgagaactacagcgactacatgacctccatgaagcggttcaagaacgagagcgagcccgagggcgccctgtggtga

SEQ ID NO: 8676 - RNA, 9879 nt, synthetic construct
  misc_feature 1..9879: note = derived and/or modified CDS sequence (opt1) from DENV-1__GU131775__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcgtggtgaccgtccacacgggcgaccagcaccaggtggggaacgagagcaccgagcacggcaccaccgcgaccatcacgccccaggcccccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgggaaggccctgaagctcagctggttcaagaagggctccagcatcgggaagatgttcgaggccaccgcccgcggcgcccggcgcatggcgatcctgggggacacggcctgggacttcggctccgtgggcggggtcttcaccagcgtgggcaagctggtgcaccagatcttcgggaccgcctacggcgtcctcttctccggggtgagctggaccatgaagatcggcatcggcgtgctgctgacgtggctcgggctgaactcccgcagcacctccctgagcatgacctgcatcgccgtcggcctcgtgaccctgtacctgggggtgatggtccaggccgactccggctgcgtgatcaactggaaggggcgggagctcaagtgcggcagcggcatcttcgtgacgaacgaggtccacacctggaccgagcagtacaagttccaggcggacagcccgaagcgcctgtccgccgccatcgggaaggcctgggaggagggcgtgtgcgggatccggagcgccacccgcctggagaacatcatgtggaagcagatctccaacgagctcaaccacatcctgctggagaacgacatgaagttcaccgtggtcgtgggcgacgtggtcgggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtggaggactacgggttcggcatcttcaccacgaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacctgcatctggcccaagtcccacacgctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtggtcgacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtgaaggagaaggaggagaacctggtcaagtccatggtgagcgccggcagcggggaggtggactccttcagcctcggcctgctgtgcatctccatcatgatcgaggaggtcatgcgcagccggtggtcccgcaagatgctcatgaccgggaccctggccgtgttcctgctcctgatcatgggccagctgacgtggaacgacctcatccggctgtgcatcatggtgggggccaacgcgagcgaccgcatgggcatgggcaccacctacctggccctcatggccaccttcaagatgcgcccgatgttcgccgtcgggctgctgttccggcgcctcacgtcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtctccctgttccccctctgcctgagcacgacctcccagaagaccacctggctgcccgtgctcctggggagcctgggctgcaagccgctcacgatgttcctgatcaccgagaacaagatctgggggcgcaagtcctggcccctgaacgagggcatcatggcggtgggggtcgtgagcatcctcctgagctccctgctcaagaacgacgtgcccctggccggccccctgatcgccggcgggatgctcatcgcctgctacgtcatcagcggctccagcgccgacctgtccctggagaaggcggccgaggtgagctgggaggaggaggccgagcactccggggccagccacaacatcctcgtggaggtccaggacgacggcaccatgaagatcaaggacgaggagcgggacgacaccctgaccatcctgctcaaggccacgctgctggcggtgtccggggtgtacccgctcagcatccccgccaccctgttcgtctggtacttctggcagaagaagaagcagcgctccggcgtgctgtgggacacccccagcccgcccgaggtggagcgggccgtcctggacgacggcatctaccgcatcatgcagcgggggctcctgggccgctcccaggtgggggtgggcgtcttccaggagaacgtgttccacaccatgtggcacgtgacgcgcggggccgtcctgatgtaccagggcaagcgcctcgagcccagctgggcctccgtgaagaaggacctgatcagctacggcgggggctggcggctgcaggggtcctggaacaccggcgaggaggtgcaggtcatcgcggtggagcccgggaagaaccccaagaacgtgcagaccgcccccggcaccttcaagacgcccgagggcgaggtcggggccatcgccctcgacttcaagcccggcaccagcgggtcccccatcgtgaaccgcgagggcaagatcgtgggcctgtacgggaacggcgtcgtgaccaccagcgggacgtacgtgagcgccatcgcgcaggccaaggcctcccaggagggcccgctgcccgagatcgaggacgaggtcttccggaagcgcaacctcaccatcatggacctgcaccccgggagcggcaagacccggcgctacctgccggccatcgtgcgggaggcgatcaagcgcaagctccggaccctgatcctggcccccacgcgcgtggtcgcctccgagatggccgaggccctcaagggcatgcccatccgctaccagaccaccgcggtcaagagcgagcacaccgggaaggagatcgtggacctgatgtgccacgccacgttcaccatgcggctgctctcccccgtccgcgtgccgaactacaacatgatcatcatggacgaggcccacttcaccgaccccagctccatcgccgcccggggctacatcagcacccgcgtggggatgggcgaggcggccgccatcttcatgacggccacgccgcccgggtccgtcgaggccttcccgcagagcaacgcggtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctgtcccggaagacgttcgacaccgagtaccagaagaccaagaacaacgactgggactacgtggtcaccacggacatcagcgagatgggggccaacttccgcgccgaccgggtgatcgacccgcgccggtgcctcaagcccgtcatcctgaaggacggccccgagcgcgtgatcctggcggggcccatgccggtgaccgtcgcctccgccgcccagcggcgcggccggatcggccgcaaccacaacaaggagggggaccagtacatctacatgggccagcccctcaacaacgacgaggaccacgcccactggaccgaggcgaagatgctgctggacaacatcaacacccccgaggggatcatccccgccctcttcgagccggagcgggagaagtccgccgccatcgacggcgagtaccgcctgcgcggggaggcccggaagacgttcgtggagctgatgcgccggggcgacctccccgtgtggctgtcctacaaggtcgcgagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgccgccgggcgccggagcgtctccggcgacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacacgatcgagaccctcatgctgctggcgctcatcgccgtgctgaccgggggcgtcaccctgttcttcctctccgggcggggcctgggcaagaccagcatcgggctgctctgcgtgatggcctccagcgtgctgctgtggatggcctccgtcgagccccactggatcgccgcgagcatcatcctcgagttcttcctgatggtgctgctcatccccgagccggaccgccagcggacgccccaggacaaccagctggcctacgtggtcatcggcctcctgttcatgatcctgaccgtggccgccaacgagatggggctgctcgagaccaccaagaaggacctgggcatcgggcacgtggccgtcgagaaccaccaccacgcgacgatgctggacgtggacctccaccccgcctccgcctggaccctgtacgccgtggccaccaccatcatcacgccgatgatgcgccacaccatcgagaacaccaccgcgaacatcagcctgacggccatcgccaaccaggccgccatcctcatgggcctggacaagggctggcccatctccaagatggacatcggggtccccctgctcgcgctgggctgctacagccaggtgaaccccctgaccctcaccgccgccgtgctgatgctggtcgcccactacgcgatcatcgggccgggcctccaggccaaggccacccgggaggcccagaagcgcacggccgcggggatcatgaagaaccccaccgtggacggcatcgtggccatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgccaccgggcccctgaccacgctgtgggagggctccccggggaagttctggaacaccaccatcgcggtgagcatggccaacatcttccggggctcctacctcgccggcgccgggctggccttcagcctgatgaagtccctcggcgggggccgccgggggaccggcgcgcagggcgagacgctgggggagaagtggaagcgccagctgaaccagctctccaagagcgagttcaacatctacaagcggtccggcatcatggaggtcgaccgcagcgaggccaaggaggggctgaagcggggcgagaccacccgccacgccgtgtcccgggggaccgccaagctgcgctggttcgtggagcggaacctggtcaagcccgagggcaaggtgatcgacctcggctgcgggcgcggcgggtggagctactactgcgcgggcctgaagaaggtgacggaggtcaaggggtacaccaagggcggccccgggcacgaggagcccatcccgatggccacctacggctggaacctggtgaagctccactccgggaaggacgtgttcttcacgccgcccgagaagtgcgacacgctgctgtgcgacatcggcgagagctcccccaacccgaccatcgaggaggggcggaccctccgcgtcctgaagatggtggagccctggctgcggggcaaccagttctgcatcaagatcctcaacccctacatgcccagcgtggtcgagaccctggagcagatgcagcgcaagcacggcgggatgctggtgcggaacccgctctcccgcaacagcacccacgagatgtactgggtgtcctgcggcacggggaacatcgtcagcgccgtgaacatgacctcccggatgctgctgaaccgcttcaccatggcccaccgcaagcccacctacgagcgggacgtggacctcggcgccggcacgcgccacgtcgcggtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtgaacggcgtcgtgaagctgctcaccaagccctgggacgtgatccccatggtcacgcagatcgccatgaccgacaccacccccttcgggcagcagcgcgtgttcaaggagaaggtggacacgcggaccccgaaggcgaagcgcggcaccgcccagatcatggaggtcaccgcccggtggctgtggggcttcctgtcccgcaacaagaagccccggatctgcacgcgcgaggagttcacccggaaggtgcgcagcaacgccgccatcggggcggtgttcgtcgacgagaaccagtggaactccgccaaggaggccgtggaggacgagcggttctgggacctcgtgcagaaggagcgcgagctgcacaagcagggcaagtgcgcgacctgcgtctacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgccgacgacaccgcggggtgggacacgcgcatcaccgaggacgacctgcagaacgaggccaagatcaccgacatcatggagccggagcacgccctgctcgccacctccatcttcaagctgacgtaccagaacaaggtggtccgggtgcagcgccccgccaagaacggcaccgtgatggacgtcatcagccgccgggaccagcgcgggtccggccaggtgggcacctacgggctgaacaccttcacgaacatggaggcgcagctcatccggcagatggagagcgagggcatcttcctgccctccgagctggagacccccaacctcgccgagcgcgtgctggactggctggagaagtacggggtcgagcggctcaagcgcatggccatcagcggcgacgactgcgtggtgaagccgatcgacgaccggttcgccaccgccctgaccgcgctgaacgacatggggaaggtccgcaaggacatcccccagtgggagccctccaagggctggaacgactggcagcaggtccccttctgcagccaccacttccaccagctcatcatgaaggacggccgggagatcgtggtcccgtgccgcaaccaggacgagctggtggggcgggcccgcgtgtcccagggcgccgggtggagcctgcgggagacggcctgcctcggcaagagctacgcccagatgtggcagctgatgtacttccaccgccgggacctgcgcctcgcggccaacgccatctgctccgccgtccccgtggactgggtgcccaccagccggaccacctggtccatccacgcgcaccaccagtggatgacgaccgaggacatgctgagcgtctggaaccgcgtgtggatcgaggagaacccctggatggaggacaagacccacgtgtccagctggggcgacgtcccgtacctgggcaagcgggaggaccagtggtgcggctccctcatcgggctgaccgcccgcgccacctgggccagcaacatccaggtggccatcaaccaggtgcgccggctgatcggcaacgagaactacctcgactacatgacgtccatgaagcgcttcaagaacgagggggaccccgagggcgcgctgtggtga

SEQ ID NO: 8677 - RNA, 9879 nt, synthetic construct
  misc_feature 1..9879: note = derived and/or modified CDS sequence (opt1) from DENV-1__GU131777__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccatctccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccacccccgggacgttcaagacccccgagggcgaggtgggcgccatcgccctggacttcaagcccgggaccagcggctcccccatcgtgaaccgcgaggggaagatcgtcggcctctacggcaacggggtggtgaccacgagcggcacctacgtcagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtgcgggaggcgatcaagcgcaagctgcgcacgctcatcctggcccccacccgggtcgtggcctccgagatggccgaggccctgaagggcatgcccatccgctaccagaccaccgcggtcaagagcgagcacacgggcaaggagatcgtcgacctcatgtgccacgccaccttcaccatgcggctgctgtcccccgtgcgcgtgccgaactacaacatgatcatcatggacgaggcccacttcaccgaccccagctccatcgccgcccgggggtacatcagcacgcgcgtcggcatgggggaggcggccgccatcttcatgaccgccacgccgcccggctccgtggaggccttcccgcagagcaacgcggtgatccaggacgaggagcgggacatccccgagcgctcctggaacagcgggtacgagtggatcaccgacttccccggcaagacggtctggttcgtgccctccatcaagagcggcaacgacatcgccaactgcctccggaagaacgggaagcgcgtgatccagctgtcccggaagaccttcgacaccgagtaccagaagaccaagaacaacgactgggactacgtcgtgacgaccgacatcagcgagatgggcgccaacttccgcgccgaccgggtgatcgacccgcgccggtgcctgaagcccgtcatcctcaaggacgggcccgagcgcgtgatcctggcgggccccatgccggtgaccgtcgcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtggagctgatgcgccgcggggacctgcccgtctggctctcctacaaggtggcgagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtgatgctccacaacagcgagcagggcgggcgggcctaccgccacgccatggaggagctgcccgacaccatcgagaccctgatgctcctggcgctgatcgccgtcctcaccggcggggtgaccctgttcttcctgtccggccgggggctcggcaagacgagcatcggcctgctgtgcgtgatggcctccagcgtcctcctgtggatggcctccgtggagccccactggatcgccgcgagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccacgaagaaggacctcgggatcggccacgtcgccgtggggaaccaccaccacgcggccatgctggacgtggacctgcaccccgcctccgcctggaccctctacgccgtcgcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtgaaccccctgaccctgaccgccgccgtcctcatgctggtggcgcactacgccatcatcgggccgggcctgcaggccaaggccacccgcgaggcccagaagcggacggcggccgggatcatgaagaaccccaccgtggacggcatcgtcgccatcgacctcgaccccgtggtgtacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtcagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtgtcccgcgggacggcgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacaccaagggcggccccgggcacgaggagcccatcccgatggccacctacggctggaacctggtgaagctgcactccgggaaggacgtcttcttcatcccgcccgagaagtgcgacacgctcctgtgcgacatcggcgagagctcccccaacccgaccatcgaggaggggcgcaccctgcgggtgctcaagatggtggagccctggctgcgcggcaaccagttctgcatcaagatcctgaacccctacatgcccagcgtcgtggagaccctcgagcagatgcagcggaagcacggcgggatgctggtgcgcaacccgctgtcccggaacagcacccacgagatgtactgggtctcctgcggcacggggaacatcgtgagcgccgtgaacatgacctcccgcatgctcctgaaccgcttcaccatggcccaccggaagcccacctacgagcgcgacgtcgacctgggcgcgggcacgcggcacgtggccgtggagcccgaggtcgccaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtgaacggcgtcgtgaagctgctgaccaagccctgggacgtcatccccatggtgacgcagatcgcgatgaccgacaccacccccttcgggcagcagcgggtgttcaaggagaaggtcgacacgcgcaccccgaaggccaagcggggcaccgcccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctggtccaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtcgtgcgcgtgcagcggcccgcgaagaacggcacggtcatggacgtgatcagccgccgggaccagcgcgggtccggccaggtgggcacctacgggctgaacaccttcaccaacatggaggcccagctgatccggcagatggagagcgagggcatcttctcccccagcgagctcgagacgcccaacctggccgagcgcgtcctggactggctcgagaagtacggggtggagcggctgaagcgcatggccatctccggcgacgactgcgtggtcaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcccgcgtcagccagggcgccgggtggagcctccgggagaccgcctgcctgggcaagtcctacgcgcagatgtggcagctgatgtacttccaccgccgggacctccgcctggccgccaacgccatctgcagcgcggtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctcggcaagcgcgaggaccagtggtgcggcagcctgatcgggctgaccgcccgggccacctgggccaccaacatccaggtcgcgatcaaccaggtgcgccggctcatcggcaacgagaactacctggactacatgacgtccatgaagcgcttcaagaacgagagcgaccccgagggggccctgtggtga

SEQ ID NO: 8678 - RNA, 9879 nt, synthetic construct
  misc_feature 1..9879: note = derived and/or modified CDS sequence (opt1) from DENV-1__GU131778__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggggagttctgcgaggacaccatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggccccgcagccacacgctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcaccacggtggtcgtggacgagcactgcggcaaccgcgggccgagcctgcggaccaccaccgtgacgggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcaccctcgccgtgttcttcctgctgatcatggggcagctcacgtggaacgacctgatccgcctgtgcatcatggtcggcgcgaacgcctccgaccgcatggggatgggcaccacctacctcgccctgatggccaccttcaagatgcggccgatgttcgccgtgggcctcctgttccgccggctgacgagccgcgaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgcgacgacaccctgaccatcctgctcaaggccaccctgctggccgtgagcggcgtgtacccgctctccatccccgccacgctgttcgtctggtacttctggcagaagaagaagcagcggagcggggtgctgtgggacatccccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacccgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagacggcccccgggaccttcaagacctccgagggcgaggtcggcgccatcgcgctcgacttcaagcccgggaccagcggcagccccatcgtgaaccgggaggggaagatcgtgggcctgtacggcaacggggtcgtgacgacctccggcacctacgtgagcgccatcgcccaggccaaggcgtcccaggaggggcccctgccggagatcgaggacgaggtcttccgcaagcggaacctcaccatcatggacctgcaccccggcagcgggaagacgcgccggtacctgcccgccatcgtgcgcgaggccatcaagcggaagctccgcaccctgatcctggccccgacccgcgtggtcgcctccgagatggcggaggccctcaagggcatgcccatccggtaccagaccacggccgtcaagagcgagcacaccggcaaggagatcgtggacctgatgtgccacgccaccttcaccatgcgcctgctctcccccgtccgggtgcccaactacaacatgatcatcatggacgaggcccacttcacggacccgagctccatcgcggcccgcgggtacatcagcacccgggtgggcatgggggaggccgccgccatcttcatgaccgcgacgccgcccggctccgtcgaggccttcccccagagcaacgccgtgatccaggacgaggagcgcgacatcccggagcggtcctggaacagcgggtacgagtggatcacggacttccccggcaagaccgtgtggttcgtcccctccatcaagagcggcaacgacatcgccaactgcctgcgcaagaacgggaagcgggtgatccagctgtcccgcaagaccttcgacaccgagtaccagaagacgaagaacaacgactgggactacgtggtcaccaccgacatcagcgagatgggcgcgaacttccgggccgaccgcgtgatcgacccccggcgctgcctcaagccggtgatcctgaaggacgggcccgagcgggtcatcctggccggccccatgcccgtgaccgtcgcctccgccgcgcagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccgcctgcggggcgaggcccgcaagaccttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacgtactccgaccccctggccctccgcgagttcaaggagttcgcggccggccggcgcagcgtctccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagaccctcatgctgctggccctcatcgccgtgctgacgggcggggtcaccctgttcttcctctccggccgcgggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccggcagcgcaccccgcaggacaaccagctggcctacgtggtcatcgggctcctcttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcggcacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgcgaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcggacgacctgggccctgtgcgagagcatcaccctcgccaccggccccctgacgaccctgtgggaggggtcccccggcaagttctggaacaccaccatcgccgtgagcatggccaacatcttccgcgggagctacctcgcgggcgccggcctggccttctccctgatgaagtccctcgggggcgggcggcgcggcacgggggcccagggcgagaccctgggcgagaagtggaagcggcagctgaaccagctctccaagagcgagttcaacacctacaagcgctccgggatcatggaggtcgaccggagcgaggcgaaggagggcctgaagcgcggggagaccacgaagcacgccgtgtcccggggcaccgccaagctgcgctggttcgtggagcggaacctcgtcaagccggaggggaaggtgatcgacctgggctgcggccgcgggggctggagctactactgcgccgggctgaagaaggtgaccgaggtcaagggctacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccggaccctccgcgtcctgaagatggtggagccgtggctgcgggggaaccagttctgcatcaagatcctcaacccctacatgcccagcgtggtcgagacgctggagcagatgcagcgcaagcacggcggcatgctggtgcggaaccccctctcccgcaacagcacccacgagatgtactgggtgtcctgcgggaccggcaacatcgtcagcgcggtgaacatgacctcccggatgctgctgaaccgcttcaccatggcccaccgcaagccgacgtacgagcgggacgtggacctcggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctcacgaagccgtgggacgtgatccccatggtcacccagatcgccatgaccgacaccacgcccttcggccagcagcgcgtgttcaaggagaaggtggacacccggacccccaaggccaagcgcgggaccgcccagatcatggaggtcacggcgaagtggctgtggggcttcctgtcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagccgcatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtggtccgcgtgcagcgcccggccaagaacgggaccgtgatggacgtcatcagccggcgcgaccagcggggctccggccaggtgggcacctacggcctgaacaccttcacgaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagacggcctgcctgggcaagtcctacgcccagatgtggcagctcatgtacttccaccggcgcgacctgcggctggccgcgaacgccatctgcagcgccgtcccggtggactgggtgcccacctcccgcaccacctggagcatccacgcccaccaccagtggatgacgaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcaccgcccgcgcgacgtgggccaccaacatccaggtcgccatcaaccaggtgcggcgcctgatcggcaacgagaactacctggactacatgacctccatgaagcggttcaagaacgagagcgacccggagggggccctctggtga

SEQ ID NO: 8679 - RNA, 9879 nt, synthetic construct
  misc_feature 1..9879: note = derived and/or modified CDS sequence (opt1) from DENV-1__GU131779__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggtctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccttctccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggcgctcctggcccctgaacgaggggatcatggcggtcggcatcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggaccatgaagatcaaggacgaggagcgggacgacaccctcaccatcctgctgaaggccacgctcctggcggtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacgcggggcgccgtcctgatgtaccaggggaagcgcctggagcccagctgggcctccgtgaagaaggacctcatcagctacggcggcgggtggcggctgcagggctcctggaacaccggggaggaggtgcaggtcatcgcggtggagcccggcaagaaccccaagaacgtgcagaccacccccgggacgttcaagacccccgagggcgaggtcggcgccatcgccctggacttcaagcccgggaccagcggctcccccatcgtgaaccgcgaggggaagatcgtgggcctctacggcaacggggtcgtgaccacgagcggcacctacgtgagcgccatcgcccaggcgaaggcctcccaggaggggccgctgcccgagatcgaggacgaggtcttccggaagcgcaacctgaccatcatggacctccaccccggcagcgggaagacccggcgctacctgccggccatcgtgcgggaggccatcaagcgcaagctgcgcacgctcatcctggcgcccacccgggtggtcgcctccgagatggccgaggccctgaagggcatgcccatccgctaccagaccaccgccgtcaagagcgagcacacgggcaaggagatcgtggacctcatgtgccacgcgaccttcaccatgcggctgctgtcccccgtccgcgtgccgaactacaacatgatcatcatggacgaggcccacttcaccgaccccagctccatcgccgcccgggggtacatcagcacgcgcgtgggcatgggggaggccgcggccatcttcatgaccgccacgccgcccggctccgtcgaggccttcccgcagagcaacgccgtgatccaggacgaggagcgggacatccccgagcgctcctggaacagcgggtacgagtggatcaccgacttccccggcaagacggtgtggttcgtcccctccatcaagagcggcaacgacatcgcgaactgcctccggaagaacgggaagcgcgtgatccagctgtcccggaagaccttcgacaccgagtaccagaagaccaagaacaacgactgggactacgtggtcacgaccgacatcagcgagatgggcgccaacttccgcgccgaccgggtgatcgacccgcgccggtgcctgaagcccgtgatcctcaaggacgggcccgagcgcgtcatcctggccggccccatgccggtgaccgtcgcgtccgccgcccagcggcgcgggcggatcggccgcaaccacaacaaggagggcgaccagtacatctacatggggcagcccctgaacaacgacgaggaccacgcccactggaccgaggccaagatgctcctggacaacatcaacacgcccgagggcatcatccccgcgctgttcgagccggagcgcgagaagtccgccgccatcgacggggagtaccggctccgcggcgaggcccggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcgcgcacctactccgaccccctggccctgcgggagttcaaggagttcgccgccggccgccggagcgtctccggggacctcatcctggagatcggcaagctgccgcagcacctcacgcagcgcgcccagaacgcgctggacaacctggtgatgctccacaacagcgagcagggcgggcgggcctaccgccacgccatggaggagctgcccgacaccatcgagaccctgatgctcctggccctgatcgcggtgctcaccggcggggtcaccctgttcttcctgtccggccgggggctcggcaagacgagcatcggcctgctgtgcgtgatggcctccagcgtgctcctgtggatggcctccgtcgagccccactggatcgccgccagcatcatcctggagttcttcctcatggtgctgctgatccccgagccggaccgccagcggacgccccaggacaaccagctcgcgtacgtggtcatcgggctgctgttcatgatcctcaccgtggccgccaacgagatgggcctgctggagaccacgaagaaggacctcgggatcggccacgtggccgtcgggaaccaccaccacgccgcgatgctggacgtggacctgcaccccgcctccgcctggaccctctacgccgtggccaccaccatcatcacgccgatgatgcgccacaccatcgagaacaccaccgcgaacatcagcctgacggccatcgccaaccaggccgccatcctgatgggcctcgacaagggctggcccatctccaagatggacatcggggtccccctgctggcgctcggctgctacagccaggtgaaccccctgaccctgaccgccgccgtgctcatgctggtcgcccactacgcgatcatcgggccgggcctgcaggccaaggccacccgcgaggcccagaagcggacggccgcggggatcatgaagaaccccaccgtggacggcatcgtggccatcgacctcgaccccgtcgtgtacgacgccaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggaagttctggaacaccaccatcgcggtgagcatggccaacatcttccggggctcctacctggccggcgccgggctcgccttcagcctgatgaagtccctgggcgggggccgccgggggaccggcgcgcagggcgagacgctcggggagaagtggaagcgccagctgaaccagctgtccaagagcgagttcaacacctacaagcggtccggcatcatggaggtcgaccgcagcgaggccaaggaggggctcaagcggggcgagaccaccaagcacgccgtgtcccgcgggacggccaagctgcggtggttcgtggagcgcaacctggtcaagcccgagggcaaggtgatcgacctgggctgcgggcggggcgggtggagctactactgcgcgggcctcaagaaggtgaccgaggtcaaggggtacaccaagggcggccccgggcacgaggagcccatcccgatggccacctacggctggaacctggtgaagctgcactccgggaaggacgtgttcttcatcccgcccgagaagtgcgacacgctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcacggggaacatcgtcagcgccgtgaacatgacctcccgcatgctcctgaaccgcttcaccatggcccaccggaagcccacctacgagcgcgacgtggacctgggcgccggcacgcggcacgtcgcggtggagcccgaggtggccaacctcgacatcatcgggcagcgcatcgagaacatcaagcacgagcacaagagcacctggcactacgacgaggacaacccctacaagacctgggcctaccacggctcctacgaggtcaagccgagcgggtccgccagcagcatggtgaacggcgtcgtgaagctgctgaccaagccctgggacgtgatccccatggtcacgcagatcgccatgaccgacaccacccccttcgggcagcagcgggtgttcaaggagaaggtggacacgcgcaccccgaaggcgaagcggggcaccgcccagatcatggaggtcaccgccaagtggctctggggcttcctgtcccgcaacaagaagccccggatctgcacgcgcgaggagttcacccggaaggtgcgcagcaacgccgccatcggggcggtgttcgtcgacgagaaccagtggaactccgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgccgacgacaccgcggggtgggacacgcggatcaccgaggacgacctccagaacgaggcccgcatcaccgacatcatggagccggagcacgccctgctggccaagtccatcttcaagctcacctaccagaacaaggtggtccgcgtgcagcggcccgccaagaacggcacggtgatggacgtcatcagccgccgggaccagcgcgggtccggccaggtgggcacctacgggctgaacaccttcaccaacatggaggcgcagctgatccggcagatggagagcgagggcatcttctcccccagcgagctcgagacgcccaacctggccgagcgcgtgctggactggctcgagaagtacggggtcgagcggctgaagcgcatggccatctccggcgacgactgcgtggtgaagccgatcgacgaccggttcgccaccgccctgaccgcgctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgccgggtggagcctccgggagaccgcctgcctgggcaagtcctacgcccagatgtggcagctgatgtacttccaccgccgggacctccgcctggcggccaacgccatctgcagcgccgtccccgtggactggatccccacgtcccggaccacctggagcatccacgcgcaccaccagtggatgaccacggaggacatgctgtccgtgtggaaccgcgtctggatcgaggagaacccctggatggaggacaagacccacatcagctcctggggcgacgtgccgtacctcggcaagcgcgaggaccagtggtgcggcagcctgatcgggctgaccgcccgggccacctgggccaccaacatccaggtggccatcaaccaggtccgccggctcatcggcaacgagaactacctggactacatgacgtccatgaagcgcttcaagaacgagagcgaccccgagggggcgctgtggtga

SEQ ID NO: 8680 - RNA, 9879 nt, synthetic construct
  misc_feature 1..9879: note = derived and/or modified CDS sequence (opt1) from DENV-1__GU131780__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttctccgggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctgagctggttcaagaaggggtccagcatcggcaagatgttcgaggccaccgcccgcggggcccggcgcatggccatcctcggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctctccgcggccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggccggcatcctggcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtcgtggacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacgtggaacgacctgatccggctgtgcatcatggtcggcgccaacgcgagcgaccgcatggggatgggcaccacctacctcgccctgatggccaccttcaagatgcgcccgatgttcgccgtgggcctcctgttccggcgcctgacgtcccgggaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagagctggcccctgaacgaggggatcatggccgtcggcatcgtgtccatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgaccctgctgacggtgtccggcgtgtacccgctcagcatccccgccaccctgttcgtctggtacttctggcagaagaagaagcagcgctccggggtgctgtgggacacccccagcccgcccaaggtggagcgggccgtcctcgacgacggcatctaccgcatcatgcagcggggcctgctggggcgctcccaggtgggcgtgggggtcttccaggagaacgtgttccacaccatgtggcacgtgacgcggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgcggtggagcccggcaagaaccccaagaacgtgcagaccgcccccgggaccttcaagacgagcgagggcgaggtcggcgccatcgccctcgacttcaagcccgggaccagcggctcccccatcgtgaaccgcgaggggaagatcgtgggcctgtacggcaacggggtcgtgaccaccagcggcacgtacgtgtccgccatcgcgcaggccaaggccagccaggaggggcccctgccggagatcgaggacgaggtcttccggaagcgcaacctcaccatcatggacctgcaccccggctccgggaagacccggcgctacctgcccgccatcgtgcgggaggcgatcaagcgcaagctccggaccctgatcctggccccgacgcgcgtggtcgccagcgagatggccgaggccctcaagggcatgcccatccgctaccagaccaccgcggtgaagtccgagcacaccggcaaggagatcgtggacctgatgtgccacgccacgttcaccatgcggctgctcagccccgtccgcgtgcccaactacaacatgatcatcatggacgaggcccacttcaccgacccgtccagcatcgccgcccgggggtacatctccacccgcgtgggcatgggggaggcggccgccatcttcatgacggccacgccgcccggcagcgtcgaggccttcccccagtccaacgcggtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccccgccggtgcctcaagccggtgatcctgaaggacgggcccgagcgcgtcatcctggcgggccccatgcccgtgaccgtcgccagcgccgcccagcggcgcgggcggatcggccgcaaccacaacaaggagggcgaccagtacatctacatggggcagccgctcaacaacgacgaggaccacgcccactggaccgaggcgaagatgctgctggacaacatcaacacccccgagggcatcatccccgccctcttcgagcccgagcgggagaagtccgccgccatcgacggggagtaccgcctgcgcggcgaggcccggaagacgttcgtggagctgatgcgccgcggggacctcccggtgtggctgtcctacaaggtcgcgagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgccgccggccgccggtccgtcagcggggacctgatcctggagatcggcaagctcccccagcacctgacccagcgcgcgcagaacgccctggacaacctcgtgatgctgcacaactccgagcagggcgggcgggcctaccgccacgccatggaggagctgccggacacgatcgagaccatgatgctcctggcgctgatcgccgtgctcaccggcggggtcaccctgttcttcctgagcggccgggggctcggcaagacctccatcggcctgctgtgcgtgatggccagctccgtgctcctgtggatggccagcgtcgagccccactggatcgccgcgtccatcatcctggagttcttcctcatggtgctgctgatccccgagcccgaccgccagcggacgccgcaggacaaccagctcgcctacgtggtcatcgggctgctgttcatgatcctcaccgtggccgccaacgagatgggcctgctggagaccaccaagaaggacctcgggatcggccacgtggccgtcgagaaccaccaccacgcggccatgctggacgtggacctgcaccccgccagcgcctggacgctctacgccgtggcgaccaccatcatcacccccatgatgcgccacacgatcgagaacaccaccgccaacatctccctgaccgccatcgccaaccaggccgcgatcctgatggggctcgacaagggctggccgatcagcaagatggacatcggcgtccccctgctggccctcgggtgctactcccaggtgaaccccctgacgctgaccgccgccgtgctcatgctggtcgcgcactacgccatcatcggccccgggctgcaggccaaggccacccgggaggcccagaagcgcaccgcggccggcatcatgaagaacccgacggtggacgggatcgtggccatcgacctcgaccccgtcgtgtacgacgccaagttcgagaagcagctgggccagatcatgctgctcatcctgtgcaccagccagatcctgctcatgcgcaccacctgggccctgtgcgagtccatcacgctggcgaccggccccctcaccaccctgtgggaggggagccccggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtcgaccgctccgaggccaaggagggcctcaagcgcggggagaccaccaagcacgccgtgagccgcggcaccgcgaagctgcggtggttcgtggagcgcaacctggtcaagccggaggggaaggtgatcgacctcggctgcggccgcggcgggtggtcctactactgcgccgggctgaagaaggtgacggaggtcaaggggtacaccaagggcgggcccggccacgaggagcccatccccatggccacctacgggtggaacctggtgaagctgcacagcggcaaggacgtgttcttcatcccgcccgagaagtgcgacaccctcctgtgcgacatcggggagtccagccccaaccccacgatcgaggagggccgcaccctgcgggtcctcaagatggtggagccgtggctgcgcgggaaccagttctgcatcaagatcctgaacccctacatgccctccgtggtcgagaccctcgagcagatgcagcggaagcacggcggcatgctggtgcgcaaccccctgagccggaactccacccacgagatgtactgggtgagctgcgggaccggcaacatcgtctccgccgtgaacatgacgagccgcatgctcctgaaccggttcaccatggcccaccgcaagccgacctacgagcgcgacgtggacctgggggcgggcacccggcacgtcgccgtggagcccgaggtggccaacctcgacatcatcggccagcgcatcgagaacatcaagcacgagcacaagtccacgtggcactacgacgaggacaacccctacaagacctgggcctaccacgggagctacgaggtcaagcccagcggctccgccagctccatggtgaacggggtcgtgaagctgctgaccaagccgtgggacgtgatccccatggtcacccagatcgcgatgacggacaccacccccttcggccagcagcgggtgttcaaggagaaggtggacacccgcacgcccaaggccaagcgggggaccgcccagatcatggaggtcaccgccaagtggctctggggcttcctgagccgcaacaagaagccgcggatctgcacccgcgaggagttcacgcggaaggtgcgctccaacgccgcgatcggcgccgtgttcgtcgacgagaaccagtggaacagcgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggtcccgggccatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgcggacgacaccgccggctgggacacccggatcacggaggacgacctccagaacgaggccaagatcaccgacatcatggagcccgagcacgccctgctggccaagagcatcttcaagctcacctaccagaacaaggtggtccgcgtgcagcggccggcgaagaacgggaccgtgatggacgtcatctcccgccgcgaccagcggggcagcggccaggtgggcacgtacggcctgaacaccttcaccaacatggaggcccagctgatccgccagatggagtccgaggggatcttcagcccctccgagctcgagacccccaacctggcccggcgcgtgctggactggctcgagaagcacggcgtcgagcggctgaagcgcatggccatcagcggggacgactgcgtggtgaagcccatcgacgaccggttcgccacggcgctgaccgccctcaacgacatgggcaaggtccgcaaggacatcccgcagtgggagcccagcaaggggtggaacgactggcagcaggtccccttctgctcccaccacttccaccagctgatcatgaaggacggccgggagatcgtggtcccctgccgcaaccaggacgagctggtgggccgggcccgcgtgagccagggggccggctggtccctccgggagaccgcctgcctgggcaagagctacgcgcagatgtggcagctgatgtacttccaccgccgggacctccgcctggccgccaacgccatctgctccgcggtcccggtggactgggtgcccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccctacctcgggaagcgggaggaccagtggtgcggctccctgatcggcctgaccgcccgcgccacctgggccaccaacatccaggtcgcgatcaaccaggtgcgccggctcatcgggaacgagaactacctggactacatgaccagcatgaagcgcttcaagaacgagtccgacccggagggcgccctgtggtga

SEQ ID NO: 8681 - RNA, 9879 nt, synthetic construct
  misc_feature 1..9879: note = derived and/or modified CDS sequence (opt1) from DENV-1__GU131781__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggacaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcgtgaactggaagggccgggagctgaagtgcgggagcggcatcttcgtgaccaacgaggtccacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtgagcctgttccccctctgcatgtccaccacgagccagaagaccacctggctgcccgtcctgctcggctccctggggtgcaagccgctgaccatgttcctcatcgccgagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcgtgctacgtgatctccgggagctccgccgacctcagcctggagaaggccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgctgtccatccccgccaccctcttcgtgtggtacttctggcagaagaagaagcagcgcagcggggtgctgtgggacacgcccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacccggggcgcggtgctgatgtaccaggggaagcgcctggagccctcctgggccagcgtgaagaaggacctcatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgcgaggggaagatcgtcggcctctacggcaacggggtggtgacgacctccggcacctacgtcagcgccatcgcccaggccaaggcgtcccaggaggggcccctgccggagatcgaggacgaggtgttccggaagcgcaacctgaccatcatggacctccaccccggcagcgggaagacgcggcgctacctgcccgccatcgtgcgggaggccatcaagcgcaagctgcggaccctcatcctggccccgacccgcgtcgtggcctccgagatggcggaggccctgaagggcatgcccatccgctaccagaccacggccgtcaagagcgagcacaccggcaaggagatcgtcgacctcatgtgccacgccaccttcaccatgcggctgctgtcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctccggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctgaagccggtcatcctcaaggacgggcccgagcgcgtgatcctggccggccccatgcccgtcaccgtggcctccgccgcgcagcggcgcgggcggatcggccgcaaccacaacaaggagggcgaccagtacgtgtacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtcgagctgatgcgccgcggggacctgccggtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtgtccggggacctcatcctggagatcggcaagctgccccagcacctcacccagcgcgcccagaacgccctggacaacctggtcatgctccacaacagcgagcagggcgggcgggcgtaccgccacgccatggaggagctgccggacaccatcgagaccctgatgctcctggccctgatcgccgtgctcacgggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagcccgaccgccagcggaccccgcaggacaaccagctcgcctacgtggtgatcgggctgctgttcatgatcctcaccgtcgccgcgaacgagatgggcctgctggagacgaccaagaaggacctcgggatcggccacgtggccgtggagaaccaccaccacgccgccatgctggacgtcgacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtgcccctgctggccctcgggtgctacagccaggtcaaccccctgaccctgaccgcggccgtgctcatgctggtggcccactacgccatcatcggccccgggctgcaggccaaggcgacgcgggaggcccagaagcgcaccgccgccggcatcatgaagaacccgaccgtcgacgggatcgtggccatcgacctcgaccccgtggtctacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagaccacgaagcacgccgtctcccgcggcaccgccaagctgcggtggttcgtggagcgcaacctggtgaagccggaggggaaggtcatcgacctcggctgcggccgcggcgggtggagctactactgcgccgggctgaagaaggtgaccgaggtgaaggggtacaccaagggcggccccggccacgaggagcccatccccatggccacgtacgggtggaacctggtcaagctgcactccggcaaggacgtgttcttcatcccgcccgagaagtgcgacaccctcctgtgcgacatcggggagagctcccccaaccccaccatcgaggagggccgcaccctgcgggtgctcaagatggtcgagccgtggctgcgcgggaaccagttctgcatcaagatcctgaacccctacatgcccagcgtggtggagacgctcgagcagatgcagcggaagcacggcggcatgctggtccgcaaccccctgtcccggaacagcacccacgagatgtactgggtgtcctgcgggaccggcaacatcgtgagcgcggtcaacatgacctcccgcatgctcctgaaccggttcaccatggcccaccgcaagccgacgtacgagcgcgacgtggacctgggggccggcacccggcacgtggccgtcgagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtggtcaagctgctgacgaagccgtgggacgtgatccccatggtgacccagatcgccatgaccgacaccacgcccttcggccagcagcgggtcttcaaggagaaggtggacacccgcacccccaaggccaagcgggggaccgcccagatcatggaggtgacggcgaagtggctctggggcttcctgtcccgcaacaagaagccgcggatctgcacccgcgaggagttcacccggaaggtccgcagcaacgccgccatcggcgccgtgttcgtggacgagaaccagtggaactccgcgaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggcccgctccatcttcaagctcacgtaccagaacaaggtggtgcgggtccagcgcccggccaagaacgggaccgtgatggacgtgatcagccgccgggaccagcgcggctccgggcaggtcggcacctacggcctgaacaccttcacgaacatggaggcccagctgatccggcagatggagagcgaggggatcttctcccccagcgagctcgagacccccaacctggccggccgcgtgctggactggctcgagaagcacggggtggagcggctgaagcgcatggcgatctccggcgacgactgcgtcgtgaagcccatcgacgaccggttcgccaccgccctgaccgccctcaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctggtcgggcgggcccgcgtgtcccagggcgcggggtggagcctccgggagacggcctgcctgggcaagtcctacgcccagatgtggcagctgatgtacttccaccgccgggacctccgcctggccgcgaacgccatctgcagcgccgtgccggtcgactgggtgcccacctcccggaccacctggagcatccacgcccaccaccagtggatgacgaccgaggacatgctgtccgtgtggaaccgcgtctggatcgaggagaacccctggatggaggacaagacccacatcagctcctggggcgacgtgccctacctcggcaagcgggaggaccagtggtgcggcagcctgatcgggctgaccgcccgcgcgacgtgggccaccaacatccaggtggccatcaaccaggtccgccggctcatcggcaacgagaactacctggactacatgacctccatgaagcgcttcaagaacgagagcgacccggagggggccctgtggtga

SEQ ID NO: 8682 - RNA, 9879 nt, synthetic construct
  misc_feature 1..9879: note = derived and/or modified CDS sequence (opt1) from DENV-1__GU131782__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccacccggggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgcccgacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcctcggcgaggtcgacagcttctccctggggctgctctgcatcagcatcatgatcgaggaggtgatgcgctcccggtggagccgcaagatgctgatggccggcaccctggccgtgttcctcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagccccaccagctgtgggccaccctcctgagcctgaccttcatcaagacgaccctctccctgcactacgcctggaagaccatggcgatggtcctgagcatcgtgtccctcttccccctgtgcctgagcaccacgtcccagaagaccacctggctcccggtgctgctgggcagcctcgggtgcaagcccctgaccatgttcctgatcgccgagaacaagatctggggccgcaagtcctggcccctcaacgaggggatcatggccgtcggcgtggtgagcatcctgctgtccagcctcctgaagaacgacgtccccctggccgggccgctcatcgccggcggcatgctgatcgcgtgctacgtgatcagcgggtccagcgccgacctgtccctcgagaaggccgccgaggtgagctgggaggaggaggccgagcactccggcgcgagccacaacatcctggtcgaggtgcaggacgacgggacgatgaagatcaaggacgaggagcgggacgacaccctgaccatcctcctgaaggccaccctgctcgccatctccggcgtgtaccccctgagcatccccgccaccctgttcgtctggtacttctggcagaagaagaagcagcgctccggggtgctgtgggacacgcccagcccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacaccggggaggaggtgcaggtcatcgccgtggagcccggcaagaacccgaagaacgtgcagacggcccccgggaccttcaagacccccgagggcgaggtcggcgccatcgcgctggacttcaagcccgggaccagcggctccccgatcgtgaaccgcgaggggaagatcgtgggcctgtacggcaacggggtcgtgacgaccagcggcacctacgtgtccgccatcgcccaggccaaggcgagccaggaggggcccctccccgagatcgaggacgaggtcttccggaagcgcaacctgaccatcatggacctgcacccgggcagcgggaagacgcggcgctacctccccgccatcgtgcgggaggccatcaagcgcaagctgcggaccctgatcctcgcccccacccgcgtggtcgcctccgagatggcggaggccctgaagggcatgcccatccgctaccagaccacggccgtcaagagcgagcacaccggcaaggagatcgtggacctgatgtgccacgccaccttcaccatgcggctcctgtccccggtccgcgtgcccaactacaacatgatcatcatggacgaggcccacttcacggaccccagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatccccgagcgctcctggaacagcgggtacgagtggatcacggacttccccggcaagaccgtgtggttcgtcccctccatcaagagcggcaacgacatcgccaactgcctgcggaagaacgggaagcgcgtgatccagctctcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagcccgtgatcctgaaggacgggcccgagcgcgtcatcctcgccggcccgatgcccgtgaccgtcgcctccgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatcccggccctgttcgagcccgagcgggagaagtccgccgcgatcgacggggagtaccgcctgcgcggcgaggcccggaagaccttcgtggagctcatgcgccgcggggacctgcccgtgtggctgtcctacaaggtcgccagcgagggcttccagtactccgaccgccggtggtgcttcgacggcgagcgcaacaaccaggtgctcgaggagaacatggacgtggagatctggaccaaggagggggagcggaagaagctgcgcccccggtggctggacgcccgcacgtacagcgacccgctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctccccgacaccatcgagaccctgatgctgctcgccctgatcgccgtgctgacgggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatcccggagcccgaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccaccatgctcgacgtggacctgcacccggcctccgcctggaccctgtacgcggtggccacgaccatcatcacccccatgatgcgccacaccatcgagaacacgaccgccaacatcagcctcaccgccatcgccaaccaggcggccatcctgatggggctggacaagggctggcccatctccaagatggacatcggcgtccccctcctggccctggggtgctacagccaggtgaacccgctcaccctgacggccgcggtgctgatgctcgtcgcccactacgccatcatcggccccgggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgtcccagatcctgctgatgcgcaccacctgggcgctctgcgagagcatcaccctggccacgggcccgctgaccaccctctgggaggggtcccccggcaagttctggaacaccacgatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgagcaagagcgagttcaacatctacaagcggtccgggatcatggaggtcgaccgcagcgaggccaaggagggcctgaagcgcggggagaccacgcgccacgcggtgtcccggggcaccgccaagctgcgctggttcgtggagcggaacctcgtcaagcccgaggggaaggtgatcgacctgggctgcggccgcgggggctggagctactactgcgccgggctgaagaaggtgaccgaggtcaagggctacaccaagggcgggcccggccacgaggagccgatccccatggccacgtacgggtggaacctcgtgaagctgcactccggcaaggacgtgttcttcacgccgcccgagcggtgcgacaccctgctctgcgacatcggggagagctccccgaaccccaccatcgaggagggccgcacgctgcgggtcctgaagatggtggagccctggctccgcgggaaccagttctgcatcaagatcctgaacccctacatgccgagcgtggtcgagaccctggagcagatgcagcggaagcacggcggcatgctcgtgcgcaaccccctgtcccggaacagcacccacgagatgtactgggtgtcctgcgggaccggcaacatcgtcagcgccgtgaacatgacctcccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccgtacaagacgtgggcctaccacgggtcctacgaggtcaagcccagcggctccgcgagctccatggtgaacggggtcgtgaagctcctgaccaagccctgggacgtgatccccatggtcacccagatcgccatgaccgacacgaccccgttcggccagcagcgggtgttcaaggagaaggtggacacccgcacccccaaggccaagcgggggacggcccagatcatggaggtcaccgcccgctggctgtggggcttcctcagccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcagaaggagcgggagctgcacaagcaggggaagtgcgccacgtgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgccctcctggcgacctccatcttcaagctgacctaccagaacaaggtggtccgcgtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttcctgccctccgagctcgagaccccgaacctggccgagcgggtgctggactggctcgagaagcacggcgtcgagcgcctgaagcggatggccatcagcggggacgactgcgtggtgaagcccatcgacgaccgcttcgcgacggccctgaccgccctcaacgacatgggcaaggtccggaaggacatcccccagtgggagccctccaaggggtggaacgactggcagcaggtcccgttctgcagccaccacttccaccagctgatcatgaaggacggccgcgagatcgtggtcccctgccggaaccaggacgagctggtgggccgcgcccgggtgtcccagggggccggctggagcctccgcgagaccgcgtgcctggggaagtcctacgcccagatgtggcagctgatgtacttccaccggcgcgacctccggctggccgccaacgcgatctgcagcgccgtccccgtggactgggtgcccaccagccgcacgacctggtccatccacgcccaccaccagtggatgaccaccgaggacatgctgagcgtctggaaccgggtgtggatcgaggagaacccgtggatggaggacaagacgcacgtgtccagctggggcgacgtcccctacctcgggaagcgcgaggaccagtggtgcggctccctgatcggcctgaccgcccgcgccacctgggcgagcaacatccaggtggccatcaaccaggtgcggcgcctcatcgggaacgagaactacctggactacatgacctccatgaagcggttcaagaacgagggcgaccccgagggggccctgtggtga

SEQ ID NO: 8683 - RNA, 9879 nt, synthetic construct
  misc_feature 1..9879: note = derived and/or modified CDS sequence (opt1) from DENV-1__GU131784__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccaccacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgccgccgtggagaaccaccaccacgccgccatgctggacgtcgacctccaccccgcgtccgcctggaccctgtacgccgtggccacgaccatcatcacccccatgatgcgccacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggcgaacatcttccgggggagctacctcgccggcgccggcctggccttctccctgatgaagtccctcgggggcgggcgccggggcaccggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcggccccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcacgatggcccaccgcaagccgacctacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcgcagatcatggaggtgaccgccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggcgcggcgcgtgctcgactggctggagaagcacggcgtggagcggctgaagcgcatggccatctccggggacgactgcgtcgtgaagcccatcgacgaccggttcgccaccgccctcacggccctgaacgacatgggcaaggtgcgcaaggacatcccgcagtgggagcccagcaaggggtggaacgactggcagcaggtccccttctgcagccaccacttccaccagctgatcatgaaggacggccgggagatcgtggtgccctgccgcaaccaggacgagctcgtcggccgggcgcgcgtgtcccagggggccggctggagcctgcgggagaccgcctgcctggggaagtcctacgcccagatgtggcagctcatgtacttccaccgccgggacctgcgcctggcggccaacgccatctgcagcgccgtgccggtcgactgggtgcccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccctacctggggaagcgggaggaccagtggtgcggcagcctgatcggcctcacggcgcgcgccacctgggccaccaacatccaggtggccatcaaccaggtccgccggctgatcgggaacgagaactacctggactacatgacctccatgaagcgcttcaagaacgagagcgacccggagggcgccctctggtga

SEQ ID NO: 8684 - RNA, 9879 nt, synthetic construct
  misc_feature 1..9879: note = derived and/or modified CDS sequence (opt1) from DENV-1__JF937612__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacgccaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatccgggacagcaaggccgtgcacgccgacatgggctactggatcgagtccgagaagaacgagacctggaagctggcgcgcgccagcttcatcgaggtcaagacctgcatctggcccaagtcccacacgctgtggagcaacggcgtgctcgagtccgagatgatcatccccaagatctacgggggcccgatcagccagcacaactaccggcccgggtacttcacccaggccgccggcccctggcacctggggaagctggagctcgacttcgacctgtgcgagggcaccaccgtggtcgtggacgagcactgcggcaaccgcgggccgtccctgcggacgaccaccgtgaccggcaagatcatccacgagtggtgctgccgcagctgcacgctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgccgcatgctcatgaccggcaccctggcggtgttcttcctgctcatcatggggcagctgacctggaacgacctgatccggctctgcatcatggtcggcgccaacgccagcgaccgcatggggatgggcacgacctacctggccctgatggccaccttcaagatgcggccgatgttcgcggtgggcctcctgttccgccggctgacctcccgcgaggtgctcctgctgacgatcgggctcagcctggtcgcctccgtggagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtcctgagcatcgtgtccctcttccccctgtgcctgagcaccacgtcccagaagaccacctggctccccgtgctgctgggcagcctcgggtgcaagccgctgaccatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgcgggcggcatgctgatcgcctgctacgtcatcagcgggtccagcgccgacctgtccctcgagaaggccgccgaggtgagctgggaggaggaggcggagcactccggcgccagccacaacatcctggtggaggtccaggacgacgggacgatgaagatcaaggacgaggagcgggacgacaccctgaccatcctcctgaaggccaccctgctcgccgtgtccggcgtgtacccgctgagcatccccgccaccctgttcgtctggtacttctggcagaagaagaagcagcgctccggggtgctctgggacacgcccagcccgcccgaggtggagcgggcggtcctggacgacggcatctaccgcatcatgcagcggggcctgctggggcgctcccaggtgggcgtgggggtcttccaggagaacgtgttccacaccatgtggcacgtgacccggggcgccgtcctcatgtaccaggggaagcgcctggagcccagctgggcctccgtgaagaaggacctgatcagctacggcggcgggtggcggctccagggctcctggaacaccggggaggaggtgcaggtcatcgccgtggagcccggcaagaaccccaagaacgtgcagacggcccccgggaccttcaagacccccgagggcgaggtcggcgcgatcgccctggacttcaagcccgggaccagcggctcccccatcgtgaaccgcgaggggaagatcgtgggcctgtacggcaacggggtcgtgacgaccagcggcacctacgtgagcgccatcgcccaggcgaaggcctcccaggaggggccgctccccgagatcgaggacgaggtcttccggaagcgcaacctgaccatcatggacctgcaccccggcagcgggaagacgcggcgctacctcccggccatcgtgcgcgaggccatcaagcggaagctgcgcaccctgatcctcgcccccacccgggtggtcgcgtccgagatggccgaggccctgaagggcatgcccatccgctaccagaccacggccgtcaagagcgagcacaccggcaaggagatcgtggacctgatgtgccacgccaccttcaccatgcggctcctgtcccccgtccgcgtgccgaactacaacatgatcatcatggacgaggcgcacttcacggaccccagctccatcgccgcccgggggtacatcagcacccgcgtgggcatgggggaggccgccgcgatcttcatgaccgccacgccgcccggctccgtcgaggccttcccgcagagcaacgccgtgatccaggacgaggagcgggacatccccgagcgctcctggaacagcgggtacgagtggatcacggacttccccggcaagaccgtgtggttcgtcccctccatcaagagcggcaacgacatcgcgaactgcctgcggaagaacgggaagcgcgtgatccagctctcccggaagaccttcgacaccgagtaccagaagacgaagaacaacgactgggactacgtggtcaccaccgacatcagcgagatgggcgccaacttccgcgccgaccgggtgatcgacccgcgccggtgcctgaagcccgtgatcctgaaggacgggcccgagcgcgtcatcctcgccggccccatgccggtgaccgtcgcctccgcggcccagcggcgcgggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccggctgcgcggcgaggcccggaagaccttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtactccgaccccctcgcgctgcgggagttcaaggagttcgccgccggccgccggagcgtctccggggacctgatcctcgagatcggcaagctgccgcagcacctgacccagcgcgcccagaacgcgctcgacaacctggtgatgctgcacaacagcgagcagggcgggcgggcctaccgccacgccatggaggagctccccgacaccatcgagaccctgatgctgctcgccctgatcgccgtgctgacgggcggggtcaccctcttcttcctgtccggccgggggctgggcaagaccagcatcggcctcctgtgcgtgatggcgtccagcgtgctgctctggatggcctccgtcgagccccactggatcgccgccagcatcatcctggagttcttcctgatggtgctcctgatccccgagccggaccgccagcgcacgccccaggacaaccagctggcctacgtggtcatcgggctcctgttcatgatcctgaccgtggcggccaacgagatgggcctcctggagacgaccaagaaggacctggggatcggccacgtggccgtcgagaaccaccaccacgccgccatgctcgacgtggacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatggggctggacaagggctggcccatctccaagatggacatcggcgtccccctcctggcgctggggtgctacagccaggtgaaccccctcaccctgaccgccgccgtgctgatgctcgtcgcccactacgccatcatcggcccggggctgcaggcgaaggccacgcgcgaggcccagaagcggaccgccgccggcatcatgaagaaccccaccgtggacgggatcgtggcgatcgacctggaccccgtcgtgtacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggcgaacatcttccgggggtcctacctggccggcgccggcctggccttcagcctcatgaagtccctcgggggcgggcgccgggggacgggggcgcagggcgagaccctgggcgagaagtggaagcgccagctcaaccagctgtccaagagcgagttcaacacctacaagcggtccgggatcatggaggtcgaccgcagcgaggccaaggagggcctgaagcgcggggagaccacgaagcacgccgtgtcccgcggcaccgccaagctccggtggttcgtggagcgcaacctggtcaagcccgaggggaaggtgatcgacctgggctgcggccgcggcgggtggagctactactgcgccgggctgaagaaggtgaccgaggtcaaggggtacaccaagggcggccccggccacgaggagcccatcccgatggcgacgtacgggtggaacctcgtgaagctgcactccggcaaggacgtgttcttcatcccgcccgagaagtgcgacaccctgctctgcgacatcggggagagctcccccaacccgaccatcgaggagggccgcaccctgcgggtcctgaagatggtggagccctggctccgcgggaaccagttctgcatcaagatcctgaacccctacatgcccagcgtggtcgagacgctggagcagatgcagcggaagcacggcggcatgctcgtgcgcaacccgctgtcccgcaacagcacccacgagatgtactgggtgtcctgcgggaccggcaacatcgtcagcgccgtgaacatgacctcccggatgctgctcaaccgcttcaccatggcccaccggaagcccacgtacgagcgcgacgtggacctgggggccggcacccggcacgtcgccgtggagcccgaggtggcgaacctggacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctcctgacgaagccctgggacgtgatccccatggtcacccagatcgccatgaccgacaccacgcccttcggccagcagcgggtgttcaaggagaaggtggacacccgcaccccgaaggccaagcgggggaccgcgcagatcatggaggtcacggccaagtggctgtggggcttcctctcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacacggccggctgggacacccgcatcaccgaggacgacctgcagaacgaggcgcggatcaccgacatcatggagccggagcacgccctcctggccaagtccatcttcaagctgacgtaccagaacaaggtggtccgcgtgcagcggcccgccaagaacgggaccgtgatggacgtcatcagccgccgggaccagcgcggctccggccaggtgggcacctacggcctcaacaccttcacgaacatggaggcccagctgatccggcagatggagagcgaggggatcttctcccccagcgagctggagacccccaacctcgcggagcgcgtgctggactggctggagaagtacggcgtcgagcggctcaagcgcatggccatctccggggacgactgcgtggtgaagccgatcgacgaccggttcgccaccgccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcgcgcgtgagccagggggccggctggagcctgcgggagacggcctgcctcgggaagtcctacgcccagatgtggcagctgatgtacttccaccgccgggacctgcgcctcgcggccaacgccatctgcagcgccgtccccgtggactggatccccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccgtacctggggaagcgcgaggaccagtggtgcggcagcctcatcggcctgaccgcgcgggccacgtgggccaccaacatccaggtggccatcaaccaggtccgccggctgatcgggaacgagaactacctcgactacatgacctccatgaagcgcttcaagaacgagagcgaccccgagggcgccctgtggtga

SEQ ID NO: 8685 - RNA, 9879 nt, synthetic construct
  misc_feature 1..9879: note = derived and/or modified CDS sequence (opt1) from DENV-1__GU131786__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccccggcccgcggggcccggcgcatggcgatcctcggcgccaccgcctgggacttcgggagcatcggcggcgtgttcccctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcgggcggacagcgggtgcgtcatcaactggaagggccgcgagctgaagtgcgggagcggcatcttcgtgaccaacgaggtgcacacctggaccgagcagtacaagttccaggccgactcccccaagcggctcagcgccgccatcggcaaggcctgggaggagggggtctgcggcatccgctccgcgacgcggctggagaacatcatgtggaagcagatcagcaacgagctgaaccacatcctcctggagaacgacatgaagctgaccgtggtggtcggggacgtggccggcatcctcgcccaggggaagaagatgatccgcccccagccgatggagtacaagtactcctggaagtcctggggcaaggccaagatcatcggcgcggacgtgcagaacaccaccttcatcatcgacgggcccaacacccccgagtgccccgacgaccagcgggcctggaacatctgggaggtcgaggactacggcttcgggatcttcacgaccaacatctggctgaagctgcgcgacagctacacccaggtgtgcgaccaccggctcatgagcgccgccatcaaggactccaaggccgtgcacgcggacatgggctactggatcgagagcgagaagaacgagacctggaagctggcccgcgcctccttcatcgaggtcaagacgtgcatctggcccaagtcccacaccctgtggtccaacggcgtgctcgagagcgagatgatcatccccaagatctacgggggccccatctcccagcacaactaccggccggggtacttcacccagaccgccggcccctggcacctggggaagctggagctcgacttcgacctgtgcgagggcacgaccgtggtcgtggacgagcactgcggcaaccgcgggcccagcctgcggaccaccacggtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctcgggctgctgtgcatcagcatcatgatcgaggaggtgatgcggtcccgctggagccggaagatgctcatgaccggcacgctggcggtgttcttcctgctcatcatggggcagctgacctggaacgacctgatccgcctctgcatcatggtcggcgccaacgcctccgaccgcatggggatgggcaccacctacctggccctgatggccacgttcaagatgcggcccatgttcgcggtgggcctcctgttccgccggctgaccagccgcgaggtgctcctgctgaccatcgggctctccctggtcgccagcgtggagctgcccaactccctcgaggagctgggcgacgggctggccatgggcatcatgatcctcaagctgctgaccgacttccagagccaccagctctgggccacgctgctgtccctcaccttcatccggaccaccttcagcctgcactacgcgtggaagacgatggccatggtcctgtccatcgtgagcctcttccccctgtgcctgtccaccaccagccagaagaccacgtggctccccgtgctgctgggctccctcgggtgcaagcccctgaccatgttcctgatcgccgagaacaagatctggggccgcaagagctggcccctcaacgaggggatcatggccgtcggcatcgtgagcatcctgctgtccagcctcctgaagaacgacgtgccgctggccgggcccctcatcgcgggcggcatgctgatcgcctgctacgtcatctccgggagctccgccgacctgagcctcgagaaggccgccgtggtgtcctgggaggaggaggcggagcacagcggcgcctcccacaacatcctggtcgaggtgcaggacgacgggaccatgaagatcaaggacgaggagcgggacgacaccctgacgatcctcctgaaggccaccctgctcgccgtgagcggcgtctaccccctgtccatccccgccaccctgttcgtgtggtacttctggcagaagaagaagcagcgcagcggggtgctctgggacaccccgagcccgcccgaggtcgagcgggcggtgctggacgacggcatctaccgcatcatgcagcggggcctgctggggcgcagccaggtgggcgtcggggtgttccaggagaacgtgttccacaccatgtggcacgtcacgcggggcgccgtgctcatgtaccaggggaagcgcctggagccctcctgggccagcgtgaagaaggacctgatctcctacggcggcgggtggcggctccagggcagctggaacaccggggaggaggtccaggtgatcgccgtggagccgggcaagaaccccaagaacgtccagaccgcccccgggaccttcaagacgtccgagggcgaggtgggcgcgatcgccctggacttcaagcccgggaccagcggcagcccgatcgtgaaccgcgaggggaagatcgtcggcctgtacggcaacggggtggtgaccacctccggcacgtacgtcagcgccatcgcccaggcgaaggcctcccaggaggggcccctccccgagatcgaggacgaggtgttccggaagcgcaacctgaccatcatggacctgcacccgggcagcgggaagacccggcgctacctccccgccatcgtgcgggaggccatcaagcgcaagctgcgcaccctgatcctcgcccccacgcgggtcgtggcgtccgagatggccgaggccctgaagggcatgcccatccgctaccagaccaccgccgtcaagagcgagcacaccggcaaggagatcgtcgacctgatgtgccacgccacgttcaccatgcggctcctgtccccggtgcgcgtgcccaactacaacatgatcatcatggacgaggcgcacttcaccgaccccagctccatcgccgcccgggggtacatcagcacccgcgtcggcatgggggaggccgccgcgatcttcatgacggccacgcccccgggctccgtggaggccttcccccagagcaacgccgtgatccaggacgaggagcgggacatccccgagcgctcctggaacagcgggtacgagtggatcaccgacttccccggcaagaccgtctggttcgtgccgtccatcaagagcggcaacgacatcgcgaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgccgaccgggtgatcgacccccgccggtgcctgaagcccgtcatcctgaaggacgggcccgagcgcgtgatcctcgccggcccgatgcccgtcaccgtggcctccgcggcccagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatcccggccctgttcgagcccgagcgcgagaagtccgcggccatcgacggggagtaccggctgcgcggcgaggcccggaagacgttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgacccgctcgcgctgcgggagttcaaggagttcgccgccggccgccggagcgtgtccggggacctgatcctcgagatcggcaagctgccccagcacctgacccagcgcgcccagaacgcgctcgacaacctggtgatgctgcacaacagcgagcagggcgggcgggcctaccgccacgccatggaggagctccccgacacgatcgagaccctgatgctgctcgccctgatcgccgtcctgaccggcggggtgaccctcttcttcctgtccggccgggggctgggcaagacgagcatcggcctcctgtgcgtgatggcgtccagcgtcctgctctggatggcctccgtggagccccactggatcgccgccagcatcatcctggagttcttcctgatggtgctcctgatcccggagcccgaccgccagcggacgccccaggacaaccagctggcctacgtcgtgatcgggctcctgttcatgatcctgaccgtggcggccaacgagatgggcctcctggagaccaccaagaaggacctggggatcggccacgtcgccgtggagaaccaccaccacgccgccatgctcgacgtggacctgcacccggcgtccgcctggacgctgtacgccgtcgccaccaccatcatcacccccatgatgcgccacacgatcgagaacaccaccgccaacatcagcctcaccgcgatcgccaaccaggccgccatcctgatggggctggacaagggctggcccatctccaagatggacatcggcgtgcccctcctggcgctggggtgctacagccaggtgaacccgctcacgctgaccgccgccgtcctgatgctcgtggcccactacgccatcatcggccccgggctgcaggcgaaggccacccgcgaggcccagaagcggaccgccgccggcatcatgaagaaccccacggtggacgggatcgtcgcgatcgacctggaccccgtggtgtacgacgccaagttcgagaagcagctcggccagatcatgctgctgatcctctgcacctcccagatcctgctgatgcgcaccacctgggccctctgcgagagcatcacgctggccaccggcccgctgaccaccctctgggaggggtcccccggcaagttctggaacacgaccatcgccgtcagcatggcgaacatcttccgggggagctacctggccggcgccggcctggccttctccctcatgaagtccctcgggggcgggcgccgggggaccggggcgcagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgccgtgtcccgcggcaccgccaagctccggtggttcgtcgagcgcaacctggtgaagcccgaggggaaggtgatcgacctgggctgcggccgcggcgggtggagctactactgcgccgggctgaagaaggtcacggaggtgaaggggtacaccaagggcgggcccggccacgaggagccgatccccatggcgacctacgggtggaacctcgtgaagctgcactccggcaaggacgtcttcttcatcccgcccgagaagtgcgacaccctgctctgcgacatcggggagagctccccgaaccccacgatcgaggagggccgcaccctgcgggtgctgaagatggtggagccctggctccgcgggaaccagttctgcatcaagatcctgaacccctacatgccgagcgtcgtggagaccctggagcagatgcagcggaagcacggcggcatgctcgtgcgcaaccccctgtcccggaacagcacccacgagatgtactgggtctcctgcgggacgggcaacatcgtgagcgccgtgaacatgacctcccgcatgctgctcaaccgcttcaccatggcccaccggaagcccacctacgagcgcgacgtcgacctgggggccggcacccggcacgtggccgtggagcccgaggtcgcgaacctggacatcatcggccagcgcatcgagaacatcaagcacgagcacaagagcacgtggcactacgacgaggacaacccgtacaagacctgggcctaccacgggtcctacgaggtgaagcccagcggcagcgcctccagcatggtcaacggggtggtgaagctcctgaccaagccctgggacgtcatccccatggtgacccagatcgccatgacggacaccaccccgttcggccagcagcgggtgttcaaggagaaggtcgacacccgcacgcccaaggccaagcgggggaccgcgcagatcatggaggtgaccgccaagtggctgtggggcttcctctcccgcaacaagaagccccggatctgcacccgcgaggagttcacgcggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcgaagatcaccgacatcatggagcccgagcacgccctcctggccaagtccatcttcaagctgacctaccagaacaaggtcgtgcgcgtgcagcgccccgccaagaacgggaccgtcatggacgtgatcagccggcgcgaccagcggggctccggccaggtgggcacgtacggcctcaacaccttcaccaacatggaggcccagctgatccgccagatggagagcgaggggatcttctcccccagcgagctggagaccccgaacctcgcgggccgggtcctggactggctggagaagcacggggtggagcgcctcaagcggatggccatctccggcgacgactgcgtggtcaagcccatcgacgaccgcttcgccacggccctgaccgccctgaacgacatggggaaggtgcggaaggacatcccccagtgggagcccagcaagggctggaacgactggcagcaggtcccgttctgcagccaccacttccaccagctcatcatgaaggacggccgcgagatcgtcgtgccctgccggaaccaggacgagctggtggggcgcgcgcgggtctcccagggcgccgggtggagcctgcgcgagaccgcctgcctcggcaagtcctacgcccagatgtggcagctgatgtacttccaccggcgcgacctgcggctcgcggccaacgccatctgcagcgccgtgcccgtggactgggtccccacctcccgcacgacctggagcatccacgcccaccaccagtggatgaccaccgaggacatgctgtccgtgtggaaccgggtgtggatcgaggagaacccgtggatggaggacaagacgcacatcagctcctggggcgacgtcccctacctgggcaagcgcgaggaccagtggtgcggcagcctcatcgggctgaccgcgcgcgccacctgggccaccaacatccaggtggccatcaaccaggtgcggcgcctgctcggcaacgagaactacctggactacatgacgtccatgaagcggttcaagaacgagagcgaccccgagggggccctgtggtga

SEQ ID NO: 8686 - RNA, 9879 nt, synthetic construct
  misc_feature 1..9879: note = derived and/or modified CDS sequence (opt1) from DENV-1__GU131787__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgggatgaagttcacggtggtggtcggcgacgtggccgggatcctcgcgcagggcaagaagatgatccggccccagcccatggagtacaagtacagctggaagtcctggggcaaggccaagatcatcggggccgacgtgcagaacaccaccttcatcatcgacggccccaacaccccggagtgccccgacgaccagcgcgcctggaacatctgggaggtcgaggactacgggttcggcatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtcgtggacgagcactgcgggaaccggggcccgtccctgcgcaccaccacggtgaccgggaagatcatccacgagtggtgctgccggagctgcaccctgccgcccctccgcttccggggcgaggacgggtgctggtacggcatggagatccgccccgtcaaggagaaggaggagaacctggtgaagtccatggtgagcgccggcagcggggaggtcgactccttcagcctcggcctgctgtgcatctccatcatgatcgaggaggtgatgcggagccgctggtcccggaagatgctcatgaccgggacgctggccgtgttcttcctgctcatcatgggccagctgacctggaacgacctgatccgcctctgcatcatggtcggggccaacgcgagcgaccgcatgggcatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggggacggcctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctggggagcctcggctgcaagccgctgaccatgttcctgatcgcggagaacaagatctgggggcggcgctcctggcccctcaacgagggcatcatggccgtcgggatcgtgagcatcctgctgagctccctcctgaagaacgacgtgcccctggccggccccctcatcgccggcgggatgctgatcgcctgctacgtcatcagcggctccagcgcggacctgtccctcgagaaggccgccgaggtgagctgggaggaggaggccgagcactccggggccagccacaacatcctggtggaggtccaggacgacggcaccatgaagatcaaggacgaggagcgggacgacaccctgaccatcctcctgaaggcgacgctgctcgccgtgtccggggtgtacccgctgagcatccccgccaccctgttcgtctggtacttctggcagaagaagaagcagcgctccggcgtgctctgggacacccccagcccgcccgaggtggagcgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccggatcacggaggacgacctgcagaacgaggcccgcatcaccgacatcatggagccggagcacgccctcctggcgcgctccatcttcaagctgacctaccagaacaaggtggtccgggtgcagcgccccgccaagaacggcaccgtgatggacgtcatcagccggcgcgaccagcgggggtccggccaggtgggcacgtacgggctcaacaccttcaccaacatggaggcccagctgatccgccagatggagagcgagggcatcttctcccccagcgagctggagacccccaacctcgccgagcgggtgctggactggctggagaagtacggggtcgagcgcctcaagcggatggccatctccggcgacgactgcgtggtgaagccgatcgacgaccgcttcgcgacggccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcgtgcctcggcaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgggaggaccagtggtgcggcagcctcatcgggctgaccgcccgcgccacctgggcgaccaacatccaggtggccatcaaccaggtccggcgcctgatcggcaacgagaactacctcgactacatgacctccatgaagcggttcaagaacgagagcgaccccgagggggccctgtggtga

SEQ ID NO: 8687 - RNA, 9879 nt, synthetic construct
  misc_feature 1..9879: note = derived and/or modified CDS sequence (opt1) from DENV-1__HM181968__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggggagctgtgcgaggacaccatgacctacaagtgcccccggatcaccgaggccgagcccgacgacgtggactgctggtgcaacgccacggacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggccacgcagaacggccggctgatcaccgccaacccgatcgtcaccgacaaggagaagcccgtgaacatcgaggcggagccgcccttcggggagtcctacatcgtgatcggcgccggcgagaaggccctgaagctcagctggttcaagaaggggtccagcatcggcaagatgttcgaggccaccgcccgcggggcgcggcgcatggccatcctgggcgacacggcctgggacttcgggtccgtcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtcgtggtgggggacgtcgtgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcgccaccaacatctggctgaagctgcgggacagctacacccaggtgtgcgaccaccgcctcatgtccgccgccatcaaggacagcaaggccgtgcacgcggacatgggctactggatcgagtccgagaagaacgagacctggaagctggcccgggccagcttcatcgaggtcaagacctgcatctggcccaagtcccacaccctgtggagcaacggcgtgctcgagtccgagatgatcatccccaagatctacgggggcccgatcagccagcacaactaccgccccgggtacttcacgcagaccgccggcccctggcacctggggaagctggagctcgacttcgacctgtgcgagggcaccaccgtggtcgtggacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggcggtgttcctgctcctgatcatggggcagctgacctggaacgacctcatccggctgtgcatcatggtcggcgccaacgccagcgaccgcatggggatgggcacgacctacctggccctcatggccaccttcaagatgcgcccgatgttcgcggtgggcctgctgctccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggccaccctcctgagcctgaccttcatcaagacgaccctctccctgcactacgcgtggaagaccatggccatggtcctgagcatcgtgtccctcttccccctgtgcctgagcaccacgtcccagaagaccacctggctccccgtgctgctgggcagcttcgggtgcaagccgctcaccatgttcctgatcacggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccggaccctgatcctggcccccacccgcgtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtcacggtggcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgggagaagtccgccgcgatcgacggggagtaccgcctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccaccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgggaggcgcagaagcgcaccgccgccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtcagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgcggtgtcccggggcaccgccaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgccgtgaacatgacgtcccggatgctgctgaaccgcttcaccatggcgcaccgcaagcccacctacgagcgggacgtcgacctcggggccggcacccgccacgtggccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctcaccaagccctgggacgtcatccccatggtgacccagatcgccatgacggacaccacccccttcggccagcagcgcgtgttcaaggagaaggtcgacacccggacgccgaaggccaagcgcgggaccgcccagatcatggaggtgaccgcccggtggctgtggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcacggaggacgacctgcagaacgaggccaagatcaccgacatcatggagccggagcacgccctgctcgcgacctccatcttcaagctgacctaccagaacaaggtcgtgcgggtgcagcgccccgccaagaacgggacggtcatggacgtgatcagccgccgggaccagcgcggctccggccaggtgggcacctacggcctgaacaccttcaccaacatggaggcccagctcatccggcagatggagagcgaggggatcttcctgccctccgagctggagacgcccaacctcgccgagcgcgtcctggactggctggagaagtacggcgtggagcggctcaagcgcatggccatcagcggggacgactgcgtggtcaagccgatcgacgaccggttcgcgaccgccctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtgggccgggcccgcgtctcccagggggccggctggagcctgcgggagaccgcgtgcctcggcaagagctacgcccagatgtggcagctgatgtacttccaccgccgggacctgcgcctcgccgccaacgcgatctgctccgccgtgcccatcgactgggtgcccacgagccggaccacctggtccatccacgcccaccaccagtggatgaccacggaggacatgctgagcgtctggaaccgcgtgtggatcgaggagaacccctggatggaggacaagacccacgtgtccagctggggcgacgtcccgtacctggggaagcgggaggaccagtggtgcggctccctcatcggcctgaccgcccgcgccacctgggcgagcaacatccaggtggccatcaaccaggtgcgccggctgatcgggaacgagaactacctcgactacatgacctccatgaagcgcttcaagaacgagggcgaccccgagggggccctgtggtga

SEQ ID NO: 8688 - RNA, 9879 nt, synthetic construct
  misc_feature 1..9879: note = derived and/or modified CDS sequence (opt1) from DENV-1__GU131789__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcacgctcatcctggcccccacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctcaaggacgggcccgagcgcgtgatcctggcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtcatgctccacaacagcgagcagggcgggcgggcctaccgccacgccatggaggagctgcccgacaccatcgagaccctgatgctcctggcgctgatcgccgtgctcaccggcggggtgaccctgttcttcctgtccggccgggggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcggacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcacggggaacatcgtgagcgccgtcaacatgacctcccgcatgctcctgaaccgcttcaccatggcccaccggaagcccacctacgagcgcgacgtggacctgggcgcgggcacgcggcacgtggccgtcgagcccgaggtggccaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgggtcttcaaggagaaggtggacacgcgcaccccgaaggccaagcggggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtggtgcgcgtccagcggcccgcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccatcctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgaccccgagggggccctgtggtga

SEQ ID NO: 8689 - RNA, 9879 nt, synthetic construct
  misc_feature 1..9879: note = derived and/or modified CDS sequence (opt1) from DENV-1__GU131790__SS-prME
  source 1..9879: mol_type = other RNA
agcgtgaccatgctgctgatgctggtgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtcggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtcacgccctccatggccatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggcgaagatctccaacaccacgaccgacagccgctgcccgacccagggcgaggccaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgcgccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtcttcaccagcgtggggaagctggtgcaccagatcttcggcaccgcctacggggtcctcttctccggcgtgagctggacgatgaagatcgggatcggcgtgctgctgacctggctcggcctgaactcccgcagcacctccctgagcatgacctgcatcgccgtcgggctcgtgacgctgtacctgggcgtgatggtccaggccgactccgggtgcgtgatcaactggaagggccgggagctcaagtgcgggagcggcatcttcgtgaccaacgaggtccacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtggtcgtgggggacgtggccggcatcctcgcgcaggggaagaagatgatccggccccagcccatggagtacaagtacagctggaagtcctggggcaaggccaagctgatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtgtgcgaccaccgcctgatgtccgcggccatcaaggacagcaaggccgtccacgccgacatgggctactggatcgagtccgagaagaacgagacctggaagctggcccgggcgagcttcatcgaggtgaagacgtgcatctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtcgtggtggacgagcactgcggcaaccgggggccgtccctccgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcacgctggccgtcttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtgggcctgctgttccgccggctcacctcccgcgaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtgaagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8690 - RNA, 9879 nt, synthetic construct
  misc_feature 1..9879: note = derived and/or modified CDS sequence (opt1) from DENV-1__GU131791__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggccgatgaagatcaaggacgaggagcgcgacgacaccctgaccatcctcctgaaggccaccctgctcgccgtgtccggcgtgtaccccctgagcatccccgccaccctgttcgtctggtacttctggcagaagaagaagcagcggtccggggtgctctgggacacgcccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacaccggggaggaggtgcaggtcatcgccgtggagcccggcaagaacccgaagaacgtgcagacggcccccgggaccttcaagacccccgagggcgaggtcggcgccatcgcgctggacttcaagcccgggaccagcggctccccgatcgtgaaccgggaggggaagatcgtgggcctgtacggcaacggggtcgtgacgaccagcggcacctacgtgagcgccatcgcccaggccaaggcgtcccaggaggggcccctccccgagatcgaggacgaggtcttccgcaagcggaacctgaccatcatggacctgcacccgggcagcgggaagacgcgccggtacctccccgccatcgtgcgcgaggccatcaagcgcaagctgcggaccctgatcctcgcccccacccgcgtggtcgcctccgagatggcggaggccctgaagggcatgcccatccggtaccagaccacggccgtcaagagcgagcacaccggcaaggagatcgtggacctgatgtgccacgccaccttcaccatgcgcctcctgtccccggtccgggtgcccaactacaacatgatcatcatggacgaggcccacttcacggaccccagctccatcgcggcccgcgggtacatcagcacccgggtgggcatgggggaggccgccgccatcttcatgaccgcgacgccgcccggctccgtcgaggccttcccccagagcaacgccgtgatccaggacgaggagcgcgacatccccgagcggtcctggaacagcgggtacgagtggatcacggacttccccggcaagaccgtgtggttcgtcccctccatcaagagcggcaacgacatcgccaactgcctgcgcaagaacgggaagcgggtgatccagctctcccgcaagaccttcgacaccgagtaccagaagacgaagaacaacgactgggactacgtggtcaccaccgacatcagcgagatgggcgcgaacttccgggccgaccgcgtgatcgacccccggcgctgcctgaagcccgtgatcctgaaggacgggcccgagcgggtcatcctcgccggcccgatgcccgtgaccgtcgcctccgccgcgcagcgccgggggcgcatcggccgcaaccacaacaaggagggcgaccagtacatctacatggggcagcccctgaacaacgacgaggaccacgcccactggacggaggccaagatgctgctcgacaacatcaacacccccgagggcatcatcccggccctgttcgagcccgagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacgtactccgacccgctcgccctgcgcgagttcaaggagttcgcggccggccggcgcagcgtctccggggacctgatcctcgagatcggcaagctgccccagcacctgacccagcgggcccagaacgccctcgacaacctggtgatcctgcacaacagcgagcagggcgggcgcgcgtaccggcacgccatggaggagctccccgacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatcccggagcccgaccggcagcgcacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcacccggcctccgcgtggaccctgtacgccgtggccaccacgatcatcacccccatgatgcgccacaccatcgagaacaccacggccaacatcagcctcaccgccatcgcgaaccaggccgccatcctgatggggctggacaagggctggcccatctccaagatggacatcggcgtccccctcctggccctggggtgctacagccaggtgaacccgctcaccctgaccgcggccgtgctgatgctcgtcgcccactacgccatcatcggccccgggctgcaggccaaggcgacgcgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacctcccagatcctgctgatgcggacgacctgggccctctgcgagagcatcaccctggccaccggcccgctgacgaccctctgggaggggtcccccggcaagttctggaacaccaccatcgccgtgagcatggccaacatcttccgcgggtcctacctggcgggcgccggcctggccttcagcctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagaccacgaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacaccaagggcggccccggccacgaggagccgatccccatggccacgtacgggtggaacctcgtgaagctgcactccggcaaggacgtgttcttcatcccgcccgagaagtgcgacaccctgctctgcgacatcggggagagctccccgaaccccaccatcgaggagggccggaccctgcgcgtcctgaagatggtggagccctggctccgggggaaccagttctgcatcaagatcctgaacccctacatgccgagcgtggtcgagacgctggagcagatgcagcgcaagcacggcggcatgctcgtgcggaaccccctgtcccgcaacagcacccacgagatgtactgggtgtcctgcgggaccggcaacatcgtcagcgcggtgaacatgacctcccgcatgctgctcaaccggttcaccatggcccaccgcaagcccacgtacgagcgggacgtggacctgggggccggcacccgccacgtcgccgtggagcccgaggtggccaacctggacatcatcggccagcggatcgagaacatcaagcacgagcacaagagcacctggcactacgacgaggacaacccgtacaagacctgggcgtaccacgggtcctacgaggtcaagcccagcggctccgccagcagcatggtgaacggggtcgtgaagctcctgacgaagccctgggacgtgatccccatggtcacccagatcgccatgaccgacaccacgccgttcggccagcagcgcgtgttcaaggagaaggtggacacccggacccccaaggccaagcgcgggaccgcccagatcatggaggtcacggcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcccgcatcaccgacatcatggagcccgagcacgcgctcctggccaagtccatcttcaagctgacgtaccagaacaaggtggtccgggtgcagcgccccgccaagaacgggaccgtgatggacgtcatcagccggcgcgaccagcggggctccggccaggtggggacctacggcctcaacaccttcacgaacatggaggcccagctgatccgccagatggagagcgaggggatcttctcccccagcgagctggagaccccgaacctcgccgagcgggtgctggactggctggagaagtacggcgtcgagcgcctcaagcggatggcgatctccggggacgactgcgtggtgaagcccatcgacgaccgcttcgccaccgccctgaccgccctgaacgacatgggcaaggtccggaaggacatcccccagtgggagcccagcaaggggtggaacgactggcagcaggtcccgttctgctcccaccacttccaccagctcatcatgaaggacggccgcgagatcgtggtcccctgccggaaccaggacgagctggtgggccgcgcccgggtgagccagggggcgggctggagcctgcgcgagacggcctgcctcgggaagtcctacgcccagatgtggcagctgatgtacttccaccggcgcgacctgcggctcgccgcgaacgccatctgcagcgccgtccccgtggactggatccccacctcccgcaccacctggagcatccacgcccaccaccagtggatgacgaccgaggacatgctgtccgtgtggaaccgcgtctggatcgaggagaacccgtggatggaggacaagacccacatcagctcctggggcgacgtgccctacctggggaagcgggaggaccagtggtgcggcagcctcatcggcctgaccgcccgcgcgacgtgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8691 - RNA, 9879 nt, synthetic construct
  misc_feature 1..9879: note = derived and/or modified CDS sequence (opt1) from DENV-1__GU131792__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccacggacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtggagccctgggccctccgccaccccgggttcacggtgatcgccctgttcctggcgcacgccatcggcacctccatcacccagaaggggatcatcttcatcctcctgatgctggtgacccccagcatggccatgcggtgcgtcggcatcggctcccgcgccttcgtggaggggctcagcggcgccacgtgggtggacgtcgtgctggagcacgggtcctgcgtgaccaccatggcgaaggacaagcccaccctggacatcgagctcctgaagacggaggtcaccaacccggccgtgctgcggaagctctgcatcgaggccaagatcagcaacaccaccacggactcccgctgccccacccagggcgaggccaccctgatggaggagcaggacgccaccttcgtgtgccggcgcacgttcgtcgaccggggctgggggaacggctgcgggctgttcggcaaggggagcctcatcacgtgcgcgaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgccaccatcacgccccaggcccccacctccgagatccagctcccggactacggggccctgaccctggactgcagcccccgcaccggcctcgacttcaacgagatggtgctgctgacgatgaaggagaagtcctggctcgtccacaagcagtggttcctggacctgcccctcccctggaccagcggggccagcacctcccaggagacctggaaccggcaggacctgctggtgacgttcaagaccgcgcacgccaagaagcaggaggtggtcgtgctcggcagccaggagggcgccatgcacaccgggctgaccggcgccacggagatccagacctccgggaccaccacgatcttcgccggccacctgaagtgccgcctcaagatggacaagctgaccctgaaggggatgagctacgtgatgtgcaccggctccttcaagctcgagaaggaggtcgcggagacccagcacggcacggtgctggtgcagatcaagtacgaggggaccgacgccccgtgcaagatccccttcagcacccaggacgagaagggcgtcacccagaacgggcggctgatcacggccaaccccatcgtgaccgacaaggagaagcccgtgaacatcgaggccgagccgcccttcggcgagtcctacatcgtcatcggcgcgggggagaaggccctgaagctcagctggttcaagaagggctccagcatcgggaagatgttcgaggccaccgcccgcggcgcccggcgcatggcgatcctgggggacaccgcctgggacttcggctccgtgggcggggtgttcacgagcgtcggcaagctggtgcaccagatcttcgggaccgcctacggcgtcctgttctccggggtcagctggaccatgaagatcggcatcggcgtgctgctgacctggctcgggctgaactcccgcagcacgtccctgagcatgacctgcatcgccgtgggcctcgtcaccctgtacctgggggtgatggtgcaggccgactccggctgcgtcatcaactggaaggggcgggagctcaagtgcggcagcggcatcttcgggaccaacgaggtgcacacgtggaccgagcagtacaagttccaggcggacagccccaagcgcctgtccgccgccatcggcaagccctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcccagggcaagaagatgatccggccgcagcccatggagcacaagtacagctggaagtcctgggggaaggcgaagatcatcggcgccgacgtgcagaacaccacgttcatcatcgacgggcccaacacccccgagtgcccggacgaccagcgcgcctggaacatctgggaggtcgaggactacggcttcggcatcttcaccaccaacatctggctgaagctgcgggacagccacacccaggtgtgcgaccaccgcctcatggccgcggccatcaaggaccggaaggccgtgcacgccgacatggggtactggatcgagtccgagaagaacgagccctggaagctggcccgcgcgagcttcatcgaggtcaagacctgcatctggcccaagtcccacaccctgtggagcaacggcgtgctcgagtccgagatgatcatcccgaagatctacgggggccccatcagccagcacaactaccggcccgggtacttcacccagacggccggcccctggcacctgggcaagctggagctcgacttcgacctgtgcgaggggaccaccgtggtcgtggacgagcactgcggcaaccgcgggccgtccctgcggaccacgaccgtgaccggcaagatcatccacgagtggtgctgccgcagctgcaccctgccgcccctccggttcaagggggaggacggctgctggtacggcatggagatccgccccgtcaaggagaaggaggagaacctggtgaagtccatggtgagcgccgggtccggcgaggtcgacagcttcagcctcgggctgctgtgcatctccatcatgatcgaggaggtgatgcggagccgctggtcccggaagatgctcatgacgggcaccctggccgtgttcctgctcctgatcatggggcagctgacctggaacgacctcatccgcctgtgcatcatggtcggcgccaacgcgagcgaccgcatgggcatggggaccacgtacctggccctcatggccaccttcaagatgcggccgatgttcgccgtgggcctgctgttccgccggctcacctcccgcgaggtgctgctgctcaccatcgggctgagcctggtcgcctccgtggagctccccaacagcctggaggagctgggcgacggcctcgcgatggggatcatgatcctgaagctgctcacggacttccagtcccaccagctgtgggccaccctgctcagcctgaccttcatcaagaccacgctgtccctccactacgcctggaagaccatggccatggtcctgagcatcgtgtccctgttccccctctgcctgagcaccacctcccagaagacgacctggctgcccgtgctcctgggcagcctggggtgcaagccgctcaccatgttcctgatcaccgagaacaagatctggggccggaagtcctggcccctgaacgaggggatcatggcggtcggcgtggtgagcatcctcctgtccagcctgctcaagaacgacgtccccctggccggccccctgatcgccgggggcatgctcatcgcctgctacgtgatcagcgggtccagcgccgacctgtccctggagaaggcggccgaggtgagctgggaggaggaggccgagcactccggcgccagccacaacatcctcgtcgaggtgcaggacgacgggacgatgaagatcaaggacgaggagcgcgacgacaccctgaccatcctgctcaaggccaccctgctggcggtgtccggcgtctacccgctcagcatccccgccaccctgttcgtgtggtacttctggcagaagaagaagcagcggtccggcgtgctgtgggacacgcccagcccgcccgaggtcgagcgcgccgtgctggacgacgggatctaccggatcatgcagcgcggcctcctggcccggtcccaggtgggggtcggcgtgttccaggagaacgtgttccacaccatgtggcacgtcacccgcggggccgtgctgatgtaccagggcaagcggctcgagcccagctgggcgtccgtgaagaaggacctgatcagctacggcgggggctggcgcctgcaggggtcctggaacaccggcgaggaggtccaggtgatcgccgtggagcccgggaagaaccccaagaacgtccagacggcccccggcaccttcaagacccccgagggcgaggtgggggccatcgccctcgacttcaagcccggcaccagcgggtccccgatcgtgaaccgggagggcaagatcgtcggcctgtacgggaacggcgtggtgacgaccagcgggacctacgtctccgcgatcgcccaggccaaggccagccaggagggccccctgcccgagatcgaggacgaggtgttccgcaagcggaacctcaccatcatggacctgcaccccgggagcggcaagacgcgccggtacctgccggcgatcgtgcgcgaggccatcaagcggaagctccgcaccctgatcctggcccccacccgcgtcgtggcctccgagatggccgaggcgctcaagggcatgcccatccggtaccagaccacggccgtcaagagcgagcacaccgggaaggagatcgtcgacctgatgtgccacgccaccttcaccatgcgcctgctctcccccgtgcgggtgccgaactacaacatgatcatcatggacgaggcccacttcacggaccccagctccatcgccgcgcgcggctacatcagcacccgggtcgggatgggcgaggccgccgccatcttcatgaccgccacgccgcccgggtccgtggaggcgttcccgcagagcaacgccgtgatccaggacgaggagcgcgacatccccgagcggtcctggaacagcggctacgagtggatcacggacttccccggcaagaccgtctggttcgtgccctccatcaagagcgggaacgacatcgccaactgcctgcgcaagaacggcaagcgggtgatccagctgtcccgcaagaccttcgacaccgagtaccagaagacgaagaacaacgactgggactacgtcgtgaccaccgacatcagcgagatgggggccaacttccgggcggaccgcgtgatcgacccgcggcgctgcctcaagcccgtcatcctgaaggacggccccgagcgggtgatcctggccgggcccatgccggtcaccgtggcctccgccgcccagcgccggggccgcatcggccggaaccacaacaaggagggggaccagtacatctacatgggccagcccctcaacaacgacgaggaccacgcgcactggacggaggccaagatgctgctggacaacatcaacacccccgaggggatcatccccgccctcttcgagccggagcgcgagaagtccgccgccatcgacggcgagtaccgcctgcgcggggaggcgcgcaagaccttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacgtacagcgaccccctggccctccgcgagttcaaggagttcgccgcggggcggcgcagcgtgtccggcgacctgatcctggagatcggcaagctcccgcagcacctgacccagcgggcccagaacgccctggacaacctcgtgatgctgcacaacagcgagcagggcgggcgcgcctaccggcacgcgatggaggagctgcccgacaccatcgagaccctcatgctgctggccctcatcgccgtcctgaccggcggggtgaccctgttcttcctctccgggcgcgggctgggcaagaccagcatcgggctgctctgcgtgatggcctccagcgtcctgctgtggatggcctccgtggagccccactggatcgcggccagcatcatcctcgagttcttcctgatggtgctgctcatcccggagcccgaccggcagcgcacgccccaggacaaccagctggcctacgtcgtgatcggcctcctcttcatgatcctgaccgtggccgccaacgagatggggctgctcgagacgaccaagaaggacctgggcatcgggcacgtcgcggtggagaaccaccaccacgccaccatgctggacgtggacctccaccccgcctccgcctggaccctgtacgccgtcgcgacgaccatcatcaccccgatgatgcggcacaccatcgagaacacgaccgccaacatcagcctgaccgccatcgccaaccaggccgcgatcctcatgggcctggacaagggctggcccatctccaagatggacatcggggtgcccctgctcgccctgggctgctacagccaggtgaaccccctgaccctcacggccgccgtcctgatgctggtggcgcactacgccatcatcgggccgggcctccaggccaaggccacccgcgaggcccagaagcgcaccgcggccgggatcatgaagaaccccaccgtggacggcatcgtcgccatcgacctggaccccgtggtgtacgacgccaagttcgagaagcagctgggccagatcatgctcctgatcctgtgcacgtcccagatcctcctgatgcggaccacctgggccctgtgcgagagcatcaccctcgcgacggggcccctgaccaccctgtgggagggctccccggggaagttctggaacaccacgatcgccgtcagcatggccaacatcttccgcggctcctacctcgccggcgccgggctggcgttcagcctgatgaagtccctcggcgggggccggcgcgggaccggcgcccagggcgagaccctgggggagaagtggaagcggcagctgaaccagctcagcaagagcgagttcaacatctacaagcgctccggcatcatggaggtggaccggagcgaggccaaggaggggctgaagcgcggcgagaccacgcggcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcaccgaggtgaaggggtacaccaagggcggccccgggcacgaggagcccatcccgatggccacgtacggctggaacctggtgaagctccactccgggaaggacgtcttcttcacgccgcccgagaagtgcgacaccctgctgtgcgacatcggcgagagctcccccaacccgaccatcgaggaggggcgcacgctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcaccgggaacatcgtgagcgccgtgaacatgacctcccgcatgctgctgaaccgcttcacgatggcccaccggaagcccacctacgagcgcgacgtcgacctcggcgcgggcacccggcacgtggccgtggagcccgaggtcgccaacctggacatcatcgggcagcgcatcgagaacatcaagcacgagcacaagagcacctggcactacgacgaggacaacccctacaagacgtgggcctaccacggctcctacgaggtgaagccgagcgggtccgccagctccatggtcaacggcgtggtgaagctgctcaccaagccctgggacgtcatccccatggtgacccagatcgcgatgaccgacacgaccccgttcgggcagcagcgggtgttcaaggagaaggtcgacacccgcacccccaaggccaagcggggcacggcccagatcatggaggtgaccgcccgctggctgtggggcttcctgagccggaacaagaagccccgcatctgcacccgggaggagttcacccgcaaggtgcggagcaacgccgcgatcggggccgtcttcgtggacgagaaccagtggaactccgccaaggaggccgtggaggacgagcgcttctgggacctcgtccagaaggagcgggagctgcacaagcagggcaagtgcgcgacgtgcgtgtacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgcggacgacaccgccgggtgggacacccggatcaccgaggacgacctgcagaacgaggccaagatcacggacatcatggagccggagcacgccctgctcgccacctccatcttcaagctgacctaccagaacaaggtcgtgcgcgtgcagcgccccgcgaagaacggcaccgtcatggacgtgatcagccggcgcgaccagcgggggtccggccaggtgggcacgtacgggctgaacaccttcaccaacatggaggcccagctcatccgccagatggagagcgagggcatcttcctgccctccgagctggagacccccaacctcgccgagcgggtcctggactggctggagaagtacggggtggagcgcctcaagcggatggccatcagcggcgacgactgcgtggtcaagccgatcgacgaccgcttcgccacggcgctgaccgccctgaacgacatggggaaggtgcggaaggacatcccccagtgggagccctccaagggctggaacgactggcagcaggtccccttctgcagccaccacttccaccagctcatcatgaaggacggccgcgagatcgtcgtgccgtgccggaaccaggacgagctggtggggcgcgcccgggtctcccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtggactgggtccccaccagccgcacgacctggtccatccacgcccaccaccagtggatgaccaccgaggacatgctgagcgtgtggaaccgggtgtggatcgaggagaacccctggatggaggacaagacgcacgtctccagctggggcgacgtgccgtacctgggcaagcgcgaggaccagtggtgcggctccctcatcgggctgaccgcccgcgccacctgggccagcaacatccaggtggcgatcaaccaggtccggcgcctgatcggcaacgagaactacctcgactacatgacctccatgaagcggttcaagaacgagggggaccccgagggcgccctgtggtga

SEQ ID NO: 8692 - RNA, 9879 nt, synthetic construct
  misc_feature 1..9879: note = derived and/or modified CDS sequence (opt1) from DENV-1__HM488256__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgagaccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgagctccgagggcgcctggaagcagatccagcgggtcgagacgtgggccctccgccacccggggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctccccgactacggggccctgaccctggactgcagcccgcgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgccaagaagcaggaggtcgtggtgctcggcagccaggagggcgcgatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggccgagacgcagcacggcaccgtgctggtgcagatcaagtacgagggcaccgacgcgccctgcaagatcccgttcagcacccaggacgagaagggggtcacgcagaacggccggctgatcaccgccaaccccatcgtgaccgacaaggagaagcccgtgaacatcgaggccgagcccccgttcggggagtcctacatcgtcatcggcgccggcgagaaggcgctcaagctgagctggttcaagaaggggtccagcatcggcaagatgttcgaggccaccgcccgcggggcccggcgcatggccatcctgggcgcgcccgcctgggacttcgggtccatcggcggcgtgttcacgagcgtggggaagctcgtccaccagatcttcggcaccgcctacggggtgctgttctccggcgtgagctggaccatgaagatcgggatcggcgtcctgctcacctggctgggcctgaactcccgcagcacgtccctcagcatgacctgcatcgccgtggggctggtgaccctgtacctcggcgtcatggtgcaggccgactccgggtgcgtgatcaactggaagggccgggagctgaagtgcgggagcggcatcttcgtcaccaacgaggtgcacacgtggaccgagcagtacaagttccaggcggacagccccaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagccgatggagcacaagtacagctggaagtcctggggcaaggccaagatcatcggcgccgacgtgcagaacaccacgttcatcatcgacgggcccaacacccccgagtgccccgacgaccagcgcgcgtggaacatctgggaggtggaggactacggcttcgggatcttcaccaccaacatctggctgaagctccgggacagctacacgcaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctgggccaagtcccacaccctctggagcaacggcgtcctggagtccgagatgatcatcccgaagatctacgggggccccatcagccagcacaactaccgccccgggtacttcacgcagaccgccggcccgtggcacctggggaagctcgagctggacttcgacctgtgcgagggcaccaccgtggtggtcgacgagcactgcggcaaccgggggccctccctccgcacgaccaccgtgaccggcaagatcatccacgagtggtgctgccggagctgcacgctgccgcccctgcgcttccgcggggaggacggctgctggtacgggatggagatctccccggtgaaggagaaggaggagaacctcgtcaagagcatggtgagcgccggctccggcgaggtggacagcttctccctggggctgctctgcatcagcatcatgatcgaggaggtcatgcgctcccggtggagccgcaagatgctgatgaccggcaccctggcggtgttcttcctcctgatcgtggggcagctgccctggaacgacctcatccggctgtgcatcatggtcggcgccaccgcctccgcccgcatggggatgggcacgaccagcctggccctcatggcgaccttcaagatgcgccccatgttcgccgtgggcctgctgttccggcgcctcacctcccgggaggtgctgctgctcacgatcgggctgagcctggtcgcctccgtggagctccccaacagcctggaggagctgggcgacgggctcgccatgggcatcatgatcctgaagctgctcaccgacttccagtcccaccagctgtgggcgaccctgctcagcctgaccttcatcaagacgaccttctccctgcactacgcctggaagaccatggccatgggcctcagcgtcgtgtccctgttcccgctgtgcctcagcaccacgtcccagaagaccacctggctgcccgtgctgctcgggagcctgggctgcaagcccctgaccatgttcctcatcgccgagaacaagatctgggggcgccggagctggcccctgaacgagggcatcatggccgtcgggatcgtgtccatcctgctcagctccctgctgaagaacgacgtgccgctcgcgggccccctgatcgccggcgggatgctgatcgcctgctacgtcatcagcggctccagcgccgacctctccctggagaaggccgcggaggtgagctgggaggaggaggccgagcactccggggccagccacaacatcctggtggaggtccaggacgacggcacgatgaagatcaaggacgaggagcgcgacgacaccctcaccatcctgctgaaggccaccctcctggccgtgtccggggtgtaccccctgagcatccccgcgaccctcttcgtctggtacttctggcagaagaagaagcagcggtccggcgtgctgtgggacacgccgtccccgcccgaggtggagcgcgccgtcctggacgacggcatctaccggatcatgcagcgcgggctgctcggccggtcccaggtgggggtgggcgtcttccaggagaacgtgttccacaccatgtggcacgtgacccgcggggccgtcctgatgtaccagggcaagcggctggagcccagctgggcctccgtgaagaaggacctcatcagctacggcgggggctggcgcctgcaggggtcctggaacaccggcgaggaggtgcaggtcatcgccgtggagccggggaagaaccccaagaacgtgcagacggcgcccggcaccttcaagacccccgagggcgaggtcggggccatcgccctggacttcaagccgggcaccagcgggagccccatcgtgaaccgggagggcaagatcgtgggcctctacgggaacggcgtcgtgacgacctccgggacctacgtgagcgccatcgcgcaggccaaggcctcccaggagggccccctgccggagatcgaggacgaggtcttccgcaagcggaacctgaccatcatggacctccaccccgggagcggcaagacgcgccggtacctgcccgccatcgtgcgcgaggccatcaagcggaagctgcgcaccctcatcctggcgcccacccgcgtggtcgcctccgagatggccgaggccctgaagggcatgccgatccggtaccagaccacggccgtcaagagcgagcacaccgggaaggagatcgtggacctcatgtgccacgcgaccttcaccatgcgcctgctgtcccccgtccgggtgcccaactacaacatgatcatcatggacgaggcccacttcacggaccccagctccatcgccgcccgcggctacatcagcacccgggtggggatgggcgaggccgcggccatcttcatgaccgccaccccgcccgggtccgtcgaggccttcccccagagcaacgcggtgatccaggacgaggagcgcgacatccccgagcggtcctggaacagcggctacgagtggatcacggacttcccgggcaagaccgtgtggttcgtcccctccatcaagagcgggaacgacatcgccaactgcctccgcaagaacggcaagcgggtgatccagctgtcccgcaagaccttcgacaccgagtaccagaagacgaagaacaacgactgggactacgtggtcaccaccgacatcagcgagatgggggccaacttccgggccgaccgcgtgatcgacccccggcgctgcctgaagcccgtgatcctcaaggacggcccggagcgggtcatcctggccgggcccatgcccgtgaccgtcgcgtccgccgcccagcgccggggccgcatcggccggaaccacaacaaggagggggaccagtacatctacatgggccagcccctgaacaacgacgaggaccacgcccactggacggaggccaagatgctcctggacaacatcaacaccccggaggggatcatccccgcgctgttcgagcccgagcgcgagaagtccgccgccatcgacggcgagtaccgcctccgcggggaggcccgcaagaccttcgtggagctgatgcggcgcggcgacctgcccgtgtggctcagctacaaggtcgcctccgagggcttccagtacagcgaccggcgctggtgcttcgacggggagcggaacaaccaggtgctggaggagaacatggacgtggagatctggaccaaggagggcgagcgcaagaagctgcggccgcgctggctcgacgcgcggacgtactccgaccccctggccctgcgcgagttcaaggagttcgccgccgggcggcgcagcgtctccggcgacctcatcctggagatcggcaagctgccccagcacctcacccagcgggcgcagaacgccctggacaacctggtgatgctccacaacagcgagcagggcgggcgcgcctaccggcacgccatggaggagctgcccgacaccatcgagaccctgatgctcctggccctgatcgcggtgctcaccggcggggtcaccctgttcttcctgtccgggcgcgggctcggcaagaccagcatcgggctgctgtgcgtgatggcctccagcgtgctcctgtggatggcctccgtcgagccgcactggatcgccgccagcatcatcctggagttcttcctcatggtgctgctgatccccgagcccgaccggcagcgcaccccgcaggacaaccagctcgcgtacgtggtcatcggcctgctgttcatgatcctcaccgtggccgccaacgagatggggctgctggagacgaccaagaaggacctcggcatcgggcacgtggccgtcgagaaccaccaccacgccgcgatgctggacgtggacctgcaccccgcctccgcctggaccctctacgccgtggccaccacgatcatcacccccatgatgcggcacaccatcgagaacaccacggcgaacatcagcctgaccgccatcgccaaccaggccgcgatcctgatgggcctcgacaagggctggcccatctccaagatggacatcggggtcccgctgctggccctcggctgctacagccaggtgaaccccctgaccctgaccgccgccgtgctcatgctggtcgcccactacgcgatcatcgggcccggcctgcaggccaaggccacgcgcgaggcccagaagcgcaccgccgcggggatcatgaagaaccccaccgtggacggcatcgtggccatcgacctcgacccggtcgtgtacgacgccaagttcgagaagcagctgggccagatcatgctgctcatcctgtgcacctcccagatcctgctcatgcggacgacctgggccctgtgcgagagcatcaccctggccaccgggcccctcacgaccctgtgggagggctcccccgggaagttctggaacaccaccatcgcggtgagcatggccaacatcttccgcggcagctacctggccggcgccgggctcgcgttctccctgatgaagtccctgggcgggggccggcgcgggacgggcgcccagggcgagaccctcggggagaagtggaagcggcagctgaaccagctgtccaagagcgagttcaacacctacaagcgctccggcatcatggaggtcgaccggagcgaggccaaggaggggctcaagcgcggcgagaccacgaagcacgccgtgtcccgggggaccgccaagctgcgctggttcgtggagcggaacctggtcaagcccgagggcaaggtgatcgacctgggctgcgggcgcggcgggtggagctactactgcgcgggcctcaagaaggtgaccgaggtcaaggggtacaccaagggcggcccggggcacgaggagcccatccccatggccacgtacggctggaacctggtgaagctgcactccgggaaggacgtgttcttcatcccgcccgagaagtgcgacaccctcctgtgcgacatcggcgagagctcccccaaccccaccatcgaggaggggcggaccctgcgcgtcctcaagatggtggagccctggctgcggggcaaccagttctgcatcaagatcctgaacccctacatgcccagcgtggtcgagacgctcgagcagatgcagcgcaagcacggcgggatgctggtgcggaaccccctgtcccgcaacagcacccacgagatgtactgggtgtcctgcggcaccgggaacatcgtcagcgccgtgaacatgacctcccggatgctcctgaaccgcttcaccatggcccaccgcaagcccacgtacgagcgggacgtggacctgggcgccggcacccgccacgtcgcggtggagccggaggtggccaacctcgacatcatcgggcagcggatcgagaacatcaagcacgagcacaagagcacctggcactacgacgaggacaacccctacaagacctgggcctaccacggctcctacgaggtcaagcccagcgggagcgcctccagcatggtgaacggcgtcgtgaagctgctgacgaagccctgggacgtgatcccgatggtcacccagatcgccatgaccgacaccacgcccttcgggcagcagcgcgtgttcaaggagaaggtggacacccggacccccaaggcgaagcgcggcaccgcccagatcatggaggtcacggccaagtggctctggggcttcctgtcccggaacaagaagccgcgcatctgcacccgggaggagttcacccgcaaggtgcggagcaacgccgcgatcggggccgtgttcgtcgacgagaaccagtggaactccgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggcgaagggcagccgcgccatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacacggcggggtgggacacccgcatcaccgaggacgacctccagaacgaggcccggatcaccgacatcatggagcccgagcacgccctgctggccaagtccatcttcaagctcacgtaccagaacaaggtggtccgcgtgcagcgccccgccaagaacggcaccgtgatggacgtcatcagccggcgcgaccagcgggggtccggccaggtgggcacctacgggctgaacaccttcacgaacatggaggcgcagctgatccgccagatggagagcgagggcatcttctccccgagcgagctcgagacccccaacctggccgagcgggtgctggactggctcgagaagtacggggtcgagcgcctgaagcggatggccatctccggcgacgactgcgtggtgaagcccatcgacgaccgcttcgccaccgccctgaccgcgctcaacgacatggggaaggtccggaaggacatcccccagtgggagccgagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgccgggtggagcctccgcgagacggcctgcctgggcaagtcctacgcgcagatgtggcagctgatgtacttccaccggcgcgacctccggctggccgccaacgccatctgcagcgccgtccccgtggactggatcccgacctcccgcaccacctggagcatccacgcgcaccaccagtggatgacgaccgaggacatgctgtccgtgtggaaccgggtctggatcgaggagaacccctggatggaggacaagacccacatcagctcctggggcgacgtgccctacctcggcaagcgcgaggaccagtggtgcggcagcctgatcgggctgaccgcccgcgccacgtgggccaccaacatccaggtggccatcaaccaggtccggcgcctcatcggcaacgagaactacctggactacatgacctccatgaagcggttcaagaacgagagcgaccccgagggggcgctgtggtga

SEQ ID NO: 8693 - RNA, 9879 nt, synthetic construct
  misc_feature 1..9879: note = derived and/or modified CDS sequence (opt1) from DENV-1__GU131793__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcaccacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgccgtgctgcggaagctctgcatcgaggcgaagatctccaacacgaccaccgacagccgctgcccgacccagggcgaggccacgctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgacggtccacaccggcgaccagcaccaggtggggaacgagtccaccgagcacggcaccaccgccacgatcacgccccaggcgcccaccaccgagatccagctcacggactacggggccctgaccctggactgcagcccccgcaccggcctcgacttcaacgagatggtcctgctgaccatgaaggagaagtcctggctcgtgcacaagcagtggttcctggacctgcccctcccctggacgagcggggccagcacctcccaggagacctggaaccggcaggacctgctggtgaccttcaagacggcccacgccaagaagcaggaggtcgtggtgctcggcagccaggagggcgcgatgcacaccgccctgaccggggccaccgagatccagacgtccggcaccaccaccatcttcgccgggcacctgaagtgccgcctcaagatggacaagctgacgctgcggggcatgagctacgtcatgtgcaccgggtccttcaagctcgagaaggaggtggccgagacccagcacggcaccgtgctggtccagatcaagtacgagggcacggacgcgccctgcaagatccccttcagcacccaggacgagaagggggtgacccagaacggccgcctgatcaccgccaacccgatcgtgacggacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccgccgcatggccatcctgggcgacaccgcgtgggacttcgggtccatcggcggcgtgttcaccagcgtcgggaagctggtgcaccagatcttcggcacggcctacggggtgctgttctccggcgtcagctggaccatgaagatcgggatcggcgtgctgctgacctggctcggcctgaactcccggagcacctccctgagcatgacgtgcatcgccgtggggctcgtcaccctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacgcggctggagaacatcatgtggaagcagatctccaacgagctcaaccacatcctgctggagaacgacatgaagttcaccgtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacacgccggagtgccccgacgaccagcgggcctggaacatctgggaggtcgaggactacggcttcgggatcttcaccaccaacatctggctgaagctgcgcgacagctacacccaggtgtgcgaccaccggctcatgtccgcggccatcaaggacagcaaggccgtgcacgccgacatgggctactggatcgagtccgagaagaacgagacgtggaagctggcccgcgcgagcttcatcgaggtcaagacctgcatctggcccaagtcccacaccctgtggagcaacggcgtgctcgagtccgagatgatcatccccaagatctacgggggcccgatcagccagcacaactaccggcccgggtacttcacccagacggccggcccctggcacctggggaagctggagctcgacttcgacctgtgcgagggcaccaccgtggtcgtggacgagcactgcggcaaccgcgggccgtccctgcggaccacgaccgtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgacgggcaccctggccgtgttcttcctgctcatcatggggcagctgacctggaacgacctgatccgcctctgcatcatggtcggcgccaacgcgagcgaccggatggggatgggcaccacgtacctggccctgatggccaccttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgacggacttccagtcccaccagctctgggccaccctgctgagcctcaccttcatcaagaccacgttctccctgcactgcgcctggaagaccatggccatggtcctgagcatcgtgtccctcttccccctgtgcctgagcaccacctcccagaagacgacctggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgacgatcctcctgaaggcgaccctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacacgatgtggcacgtgacccgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggaccagcggctcccccatcgtgaaccgggaggggaagatcgtgggcctgtacggcaacggggtcgtgaccacgagcggcacctacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggacgctgatcctcgcccccacccgcgtggtcgcctccgagatggccgaggcgctgaagggcatgcccatccggtaccagaccaccgccgtcaagagcgagcacacgggcaaggagatcgtggacctgatgtgccacgccaccttcaccatgcgcctcctgtcccccgtccgggtgccgaactacaacatgatcatcatggacgaggcccacttcaccgaccccagctccatcgccgcgcgcgggtacatcagcacgcgggtgggcatgggggaggccgccgccatcttcatgaccgccacgccgcccggctccgtcgaggcgttcccgcagagcaacgccgtgatccaggacgaggagcgcgacatccccgagcggtcctggaacagcgggtacgagtggatcaccgacttccccggcaagacggtgtggttcgtcccctccatcaagagcggcaacgacatcgccaactgcctgcgcaagaacgggaagcgggtgatccagctctcccgcaagaccttcgacaccgagtaccagaagaccaagaacaacgactgggactacgtggtcacgaccgacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgggagaagtccgccgccatcgacggggagtaccgcctgcggggcgaggcgcgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacgcagcgggcccagaacgccctcgacaacctggtgatgctgcacaacagcgagcagggcgggcgcgcctaccggcacgcgatggaggagctccccgacaccatcgagaccctgatgctgctcgccctgatcgccgtgctgaccggcggggtcaccctcttcttcctgtccggccgcgggctgggcaagacgagcatcggcctcctgtgcgtgatggcctccagcgtgctgctctggatggcctccgtcgagccccactggatcgcggccagcatcatcctggagttcttcctgatggtgctcctgatccccgagccggacaagcagcggacgccccaggacaaccagctggcctacgtggtcatcgggctcctgttcatgatcctgaccgtggccgccaacgagatgggcctcctggagaccacgaagaaggacctggggatcggccacgtggcggtcgagaaccaccaccacgccgccatgctcgacgtggacctgcaccccgcctccgcctggaccctgtacgcggtggccaccaccatcatcacgccgatgatgcgccacaccatcgagaacaccaccgccaacatcagcctcacggccatcgccaaccaggcggccatcctgatggggctggacaagggctggcccatctccaagatggacatcggcgtccccctcctggccctggggtgctacagccaggtgaaccccctcaccctgaccgccgcggtgctgatgctcgtcgcccactacgccatcatcggcccggggctgcaggccaaggccacccgcgaggcgcagaagcggacggccgccggcatcatgaagaaccccaccgtggacgggatcgtggccatcgacctggaccccgtcgtgtacgacgccaagttcgagaagcagctcggccagatcatgctgctgatcctctgcacctcccagatcctgctgatgcgcaccacgtgggcgctctgcgagagcatcaccctggccaccggccccctgaccacgctctgggaggggtccccgggcaagttctggaacaccaccatcgccgtgagcatggccaacatcttccgggggtcctacctggccggcgcgggcctggccttcagcctcatgaagtccctcgggggcgggcgccgggggaccggggcccagggcgagacgctgggcgagaagtggaagcgccagctcaaccagctgtccaagagcgagttcaacacctacaagcggtccgggatcatggaggtcgaccgcagcgaggccaaggagggcctgaagcgcggggagaccaccaagcacgcggtgtcccgcggcacggccaagctccggtggttcgtggagcgcaacctggtcaagcccgaggggaaggtgatcgacctgggctgcggccgcggcgggtggagctactactgcgccgggctgaagaaggtgaccgaggtcaaggggtacaccaagggcggccccggccacgaggagcccatcccgatggccacctacgggtggaacctcgtgaagctgcactccggcaaggacgtgttcttcatcccgcccgagaagtgcgacacgctgctctgcgacatcggggagagctcccccaacccgaccatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggacgggcaacatcgtcagcgccgtgaacatgacctcccgcatgctgctcaaccgcttcaccatggcgcaccggaagcccacctacgagcgcgacgtggacctgggggccggcacgcggcacgtcgccgtggagcccgaggtggccaacctggacatcatcggccagcgcatcgagaacatcaagcacgagcacaagagcacctggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacgcagatcgccatgaccgacaccacccccttcggccagcagcgggtgttcaaggagaaggtggacacgcgcaccccgaaggccaagcgggggaccgcccagatcatggaggtcaccgccaagtggctgtggggcttcctctcccgcaacaagaagccccggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacgcggatcaccgaggacgacctgcagaacgaggcccgcatcaccgacatcatggagccggagcacgccctcctggcgaagtccatcttcaagctgacctaccagaacaaggtggtccgcgtgcagcggcccgccaagaacgggacggtgatggacgtcatcagccgccgggaccagcgcggctccggccaggtgggcacctacggcctcaacaccttcaccaacatggaggcccagctgatccggcagatggagagcgaggggatcttctcccccagcgagctggagacgcccaacctcgccgagcgcgtgctggactggctggagaagtacggcgtcgagcggctcaagcgcatggccatctccggggacgactgcgtggtgaagccgatcgacgaccggttcgcgaccgccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctggggaagcgcgaggaccagtggtgcggcagcctcatcggcctgaccgcccgggccacctgggcgaccaacatccaggtggccatcaaccaggtccgccggctgatcgggaacgagaactacctcgactacatgacgtccatgaagcgcttcaagaacgagagcgaccccgagggcgccctgtggtga

SEQ ID NO: 8694 - RNA, 9879 nt, synthetic construct
  misc_feature 1..9879: note = derived and/or modified CDS sequence (opt1) from DENV-1__GU131794__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtggggctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgtggtgtcctgggaggaggaggccgagcacagcggcgcgtcccacaacatcctggtcgaggtgcaggacgacgggacgatgaagatcaaggacgaggagcgcgacgacaccctgaccatcctcctgaaggccaccctgctcgccgtgagcggcgtctacccgctgtccatccccgccaccctgttcgtgtggtacttctggcagaagaagaagcagcggagcggggtgctctgggacacgcccagcccgcccgaggtcgagcgcgccgtgctggacgacggcatctaccggatcatgcagcgcggcctgctggggcggagccaggtgggcgtcggggtgttccaggagaacgtgttccacaccatgtggcacgtcacccgcggcgcggtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaaccccaagaacgtccagacggcccccgggaccttcaagacctccgagggcgaggtgggcgccatcgcgctggacttcaagcccgggaccagcggcagccccatcgtgaaccgggaggggaagatcgtcggcctgtacggcaacggggtggtgacgacctccggcacctacgtcagcgccatcgcccaggccaaggcgtcccaggaggggcccctcccggagatcgaggacgaggtgttccgcaagcggaacctgaccatcatggacctgcaccccggcagcgggaagacgcgccggtacctccccgccatcgtgcgcgaggccatcaagcggaagctgcgcaccctgatcctcgccccgacccgcgtcgtggcctccgagatggcggaggccctgaagggcatgcccatccggtaccagaccacggccgtcaagagcgagcacaccggcaaggagatcgtcgacctgatgtgccacgccaccttcaccatgcgcctcctgtcccccgtgcgggtgcccaactacaacatgatcatcatggacgaggcccacttcacggacccgagctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatcccggagcggtcctggaacagcgggtacgagtggatcacggacttccccggcaagaccgtctggttcgtgccctccatcaagagcggcaacgacatcgccaactgcctgcgcaagaacgggaagcgggtgatccagctctcccgcaagaccttcgacaccgagtaccagaagacgaagaacaacgactgggactacgtcgtgaccaccgacatcagcgagatgggcgcgaacttccgggccgaccgcgtgatcgacccccggcgctgcctgaagccggtcatcctgaaggacgggcccgagcgggtgatcctcgccggccccatgcccgtcaccgtggcctccgccgcgcagcgccgggggcgcatcggccggaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtggagctcatgcggcgcggggacctgccggtctggctgagctacaaggtggcctccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgaccccctcgccctgcgcgagttcaaggagttcgcggccggccggcgcagcatctccggggacctgatcctcgagatcggcaagctgccccagcacctgacccagcgggcccagaacgccctcgacaacctggtgatgctgcacaacagcgagcagggcgggcgcgcgtaccggcacgccatggaggagctcccggacaccatcgagaccctgatgctgctcgccctgatcgccgtgctgacgggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccggcagcgcaccccgcaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcacccccatgatgcggcacaccatcgagaacaccacggccaacatcagcctcaccgccatcgcgaaccaggccgccatcctgatggggctggacaagggctggccgatctccaagatggacatcggcgtccccctcctggccctggggtgctacagccaggtgaaccccctcaccctgaccgcggccgtgctgatgctcgtcgcccactacgccatcatcggccccgggctgcaggccaaggcgacgcgcgaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtgagcatggccaacatcttccgcgggagctacctggcgggcgccggcctggccttctccctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagaccacgaagcacgccgtgtcccggggcaccgccaagctccgctggttcgtggagcggaacctggtcaagccggaggggaaggtgatcgacctgggctgcggccgcgggggctggagctactactgcgccgggctgaagaaggtgaccgaggtcaagggctacaccaagggcgggcccggccacgaggagcccatccccatggccacgtacgggtggaacctcgtgaagctgcactccggcaaggacgtgttcttcatcccgcccgagaagtgcgacaccctgctctgcgacatcggggagagctcccccaaccccaccatcgaggagggccggaccctgcgcgtcctgaagatggtggagccgtggctccgggggaaccagttctgcatcaagatcctgaacccctacatgcccagcgtggtcgagacgctggagcagatgcagcgcaagcacggcggcatgctcgtgcggaaccccctgtcccgcaacagcacccacgagatgtactgggtgtcctgcgggaccggcaacatcgtcagcgcggtgaacatgacctcccggatgctgctcaaccgcttcaccatggcccaccgcaagccgacgtacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctcctgacgaagccgtgggacgtgatccccatggtcacccagatcgccatgaccgacaccacgcccttcggccagcagcgcgtgttcaaggagaaggtggacacccggacccccaaggccaagcgcgggaccgcccagatcatggaggtcacggcgaagtggctgtggggcttcctctcccggaacaagaagccgcgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagcccgagcacgcgctcctggccaagtccatcttcaagctgacgtaccagaacaaggtggtccgggtgcagcgcccggccaagaacgggaccgtgatggacgtcatcagccgccgggaccagcgcggctccggccaggtgggcacctacggcctcaacaccttcacgaacatggaggcccagctgatccggcagatggagagcgaggggatcttctcccccagcgagctggagacccccaacctcgccggccgcgtgctggactggctggagaagcacggggtcgagcggctcaagcgcatggcgatctccggcgacgactgcgtggtgaagcccatcgacgaccggttcgccaccgccctgaccgccctgaacgacatggggaaggtccgcaaggacatcccgcagtgggagcccagcaagggctggaacgactggcagcaggtccccttctgcagccaccacttccaccagctcatcatgaaggacggccgggagatcgtggtcccctgccgcaaccaggacgagctggtggggcgggcccgcgtgtcccagggcgcggggtggagcctgcgggagacggcctgcctcggcaagtcctacgcccagatgtggcagctgatgtacttccaccgccgggacctgcgcctcgccgcgaacgccatctgcagcgccgtcccggtggactgggtgcccacctcccggaccacctggagcatccacgcccaccaccagtggatgacgaccgaggacatgctgtccgtctggaaccgcgtgtggatcgaggagaacccctggatggaggacaagacccacatcagctcctggggcgacgtgccctacctgggcaagcgggaggaccagtggtgcggcagcctcatcgggctgaccgcccgcgcgacgtgggccaccaacatccaggtcgccatcaaccaggtgcgccggctgctcggcaacgagaactacctggactacatgacctccatgaagcgcttcaagaacgagagcgacccggagggggccctgtggtga

SEQ ID NO: 8695 - RNA, 9879 nt, synthetic construct
  misc_feature 1..9879: note = derived and/or modified CDS sequence (opt1) from DENV-1__GU131796__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcgtggaggccaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatgacgtgcgccaagttcaagtgcgtcaccaagctcgagggcaagatcgtgcagtacgagaacctgaagtacagcgtgatcgtcaccgtgcacaccggcgaccagcaccaggtcgggaacgagtccacggagcacggcaccaccgcgaccatcacgccccaggcccccagcacggagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggaccagcggggcctccaccagccaggagacctggaaccggaaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggcggagacccagcacggcacggtcctcgtgcagatcaagtacgagggcaccgacgccccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtcttcacgtccgtggggaagctggtgcaccagatcttcggcaccgcctacggggtcctgttcagcggcgtgtcctggaccatgaagatcgggatcggcgtgctcctgacctggctgggcctcaacagccgctccacgagcctgtccatgacctgcatcgccgtcgggctggtgaccctctacctgggcgtgatggtccaggccgacagcgggtgcgtgatcaactggaagggccgggagctgaagtgcgggagcggcatcttcgtgaccaacgaggtccacacgtggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagctgaccgtggtcgtgggggacgtggcgggcatcctcgcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctgaagctgcgggactcctacacccaggtgtgcgaccaccgcctcatgagcgccgccatcaaggactccaaggccgtccacgccgacatgggctactggatcgagagcgagaagaacgagacctggaagctggcgcgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtcgtggtggacgagcactgcggcaaccgggggccgagcctgcgcacgaccaccgtcaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacctggaacgacctgatccggctctgcatcatggtgggcgcgaacgcctccgaccgcatggggatgggcacgacctacctggccctgatggccaccttcaagatgcgcccgatgttcgccgtgggcctcctgttccggcgcctgaccagccgggaggtcctcctgctgacgatcgggctctccctggtggcgagcgtcgagctgcccaactccctcgaggagctgggcgacgggctggccatgggcatcatgatcctcaagctgctgaccgacttccagagccaccagctctgggccaccctgctgtccctcaccttcatcaagacgaccagctccctgcactacgcctggaagaccatggcgatggtgctgagcatcgtgtccctcttccccctgtgcctgagcaccacgtcccagaagaccacctggctccccgtcctgctgggcagcctcgggtgcaagccgctgaccatgttcctgatcgccgagaacaagatctggggccgcaagagctggcccctcaacgaggggatcatggccgtgggcatcgtgtccatcctgctgagcgccctcctgaagaacgacgtccccctggccgggcccctcatcgcgggcggcatgctgatcgcctgctacgtgatctccgggagctccgccgacctgagcctcgagaaggccgccgaggtgtcctgggaggaggaggcggagcacagcggcgcctcccacaacatcctggtcgaggtgcaggacgacgggacgatgaagatcaaggacgaggagcgggacgacaccctgaccatcctcctgaaggccaccctgctcgccgtgagcggcgtctacccgctgtccatccccgccaccctgttcgtgtggtacttctggcagaagaagaagcagcgcagcggggtgctctgggacacgcccagcccgcccgaggtcgagcgggcggtgctggacgacggcatctaccgcatcatgcagcggggcctgctggggcgcagccaggtgggcgtcggggtgttccaggagaacgtgttccacaccatgtggcacgtcacccggggcgccgtgctcatgtaccaggggaagcgcctggagccctcctgggccagcgtgaagaaggacctgatctcctacggcggcgggtggcggctccagggcagctggaacaccggggaggaggtccaggtgatcgccgtggagcccggcaagaaccccaagaacgtccagacggcccccgggaccttcaagacctccgagggcgaggtgggcgcgatcgccctggacttcaagcccgggaccagcggcagccccatcgtgaaccgcgaggggaagatcgtcggcctgtacggcaacggggtggtgacgacctccggcacctacgtcagcgccatcgcccaggcgaaggcctcccaggaggggcccctcccggagatcgaggacgaggtgttccggaagcgcaacctgaccatcatggacctgcaccccggcagcgggaagacgcggcgctacctccccgccatcgtgcgggaggccatcaagcgcaagctgcggaccctgatcctcgccccgacccgcgtcgtggcgtccgagatggccgaggccctgaagggcatgcccatccgctaccagaccacggccgtcaagagcgagcacaccggcaaggagatcgtcgacctgatgtgccacgccaccttcaccatgcggctcctgtcccccgtgcgcgtgcccaactacaacatgatcatcatggacgaggcgcacttcacggacccgagctccatcgccgcccgggggtacatcagcacccgcgtcggcatgggggaggccgccgcgatcttcatgaccgccacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgcgaactgcctgcggaagaacgggaagcgcgtgatccagctctcccggaagaccttcgacaccgagtaccagaagacgaagaacaacgactgggactacgtcgtgaccaccgacatcagcgagatgggcgccaacttccgcgccgaccgggtgatcgacccccgccggtgcctgaagccggtcatcctgaaggacgggcccgagcgcgtgatcctcgccggccccatgcccgtcaccgtggcctccgcggcccagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgcggccatcgacggggagtaccgcctgcgcggcgaggcccggaagaccttcgtggagctcatgcgccgcggggacctgccggtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacgtactccgaccccctcgcgctgcgggagttcaaggagttcgccgccggccgccggagcgtgtccggggacctgatcctcgagatcggcaagctgccccagcacctgacccagcgcgcccagaacgcgctcgacaacctggtgatgctgcacaacagcgagcagggcgggcgggcctaccgccacgccatggaggagctcccggacaccatcgagaccctgatgctgctcgccctgatcgccgtcctgacgggcggggtgaccctcttcttcctgtccggccgggggctgggcaagaccagcatcggcctcctgtgcgtgatggcgtccagcgtcctgctctggatggcctccgtggagccccactggatcgccgccagcatcatcctggagttcttcctgatggtgctcctgatccccgagcccgaccgccagcggaccccgcaggacaaccagctggcctacgtcgtgatcgggctcctgttcatgatcctgaccgtggcggccaacgagatgggcctcctggagacgaccaagaaggacctggggatcggccacgtcgccgtggagaaccaccaccacgccgccatgctcgacgtggacctgcaccccgcgtccgcctggaccctgtacgccgtcgccaccacgatcatcacccccatgatgcgccacaccatcgagaacaccacggccaacatcagcctcaccgcgatcgccaaccaggccgccatcctgatggggctggacaagggctggccgatctccaagatggacatcggcgtgcccctcctggcgctggggtgctacagccaggtgaaccccctcaccctgaccgccgccgtcctgatgctcgtggcccactacgccatcatcggccccgggctgcaggcgaaggccacgcgggaggcccagaagcgcaccgccgccggcatcatgaagaacccgaccgtggacgggatcgtcgcgatcgacctggaccccgtggtgtacgacgccaagttcgagaagcagctcggccagatcatgctgctgatcctctgcacctcccagatcctgctgatgcgcacgacctgggccctctgcgagagcatcaccctggccaccggccccctgacgaccctctgggaggggtcccccggcaagttctggaacaccaccatcgccgtcagcatggcgaacatcttccgggggagctacctggccggcgccggcctggccttctccctcatgaagtccctcgggggcgggcgccgggggacgggggcgcagggcgagaccctgggcgagaagtggaagcgccagctcaaccagctgtccaagagcgagttcaacacctacaagcggtccgggatcatggaggtggaccgcagcgaggccaaggagggcctgaagcgcggggagaccacgaagcacgccgtgtcccgcggcaccgccaagctccggtggttcgtcgagcgcaacctggtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggcgacgtacgggtggaacctcgtgaagctgcactccggcaaggacgtcttcttcatcccgcccgagaagtgcgacaccctgctctgcgacatcggggagagctcccccaaccccaccatcgaggagggccgcaccctgcgggtgctgaagatggtggagccgtggctccgcgggaaccagttctgcatcaagatcctgaacccctacatgcccagcgtcgtggagacgctggagcagatgcagcggaagcacggcggcatgctcgtgcgcaaccccctgtcccggaacagcacccacgagatgtactgggtctcctgcgggaccggcaacatcgtgagcgccgtgaacatgacctcccgcatgctgctcaaccggttcaccatggcccaccgcaagccgacgtacgagcgcgacgtcgacctgggggccggcacccggcacgtggccgtggagcccgaggtcgcgaacctggacatcatcggccagcgcatcgagaacatcaagcacgagcacaagagcacctggcactacgacgaggacaacccctacaagacctgggcctaccacgggtcctacgaggtgaagcccagcggcagcgcctccagcatggtcaacggggtggtgaagctcctgacgaagccgtgggacgtcatccccatggtgacccagatcgccatgaccgacaccacgcccttcggccagcagcgggtgttcaaggagaaggtcgacacccgcacccccaaggccaagcgggggaccgcgcagatcatggaggtgacggccaagtggctgtggggcttcctctcccgcaacaagaagccgcggatctgcacccgcgaggagttcacccggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacacggccggctgggacacccggatcaccgaggacgacctgcagaacgaggcgaagatcaccgacatcatggagcccgagcacgccctcctggccaagtccatcttcaagctgacgtaccagaacaaggtcgtgcgcgtgcagcggccggccaagaacgggaccgtcatggacgtgatcagccgccgcgaccagcggggctccggccaggtgggcacctacggcctcaacaccttcacgaacatggaggcccagctgatccgccagatggagagcgaggggatcttctcccccagcgagctggagacccccaacctcgcgggccgggtcctggactggctggagaagcacggggtggagcgcctcaagcggatggccatctccggcgacgactgcgtggtcaagcccatcgacgaccgcttcgccgccgccctgaccgcgctgaacgacatggggaaggtgcggaaggacatcccgcagtgggagcccagcaagggctggaacgactggcagcaggtccccttctgcagccaccacttccaccagctcatcatgaaggacggccgcgagatcgtcgtgccctgccggaaccaggacgagctggtggggcgcgcccgggtctcccagggcgccgggtggagcctgcgcgagaccgcctgcctcggcaagtcctacgcgcagatgtggcagctgatgtacttccaccggcgcgacctgcggctcgccgccaacgccatctgcagcgccgtgccggtggactgggtccccacgtcccgcaccacctggagcatccacgcgcaccaccagtggatgaccacggaggacatgctgtccgtgtggaaccgggtgtggatcgaggagaacccctggatggaggacaagacccacatcagctcctggggcgacgtcccctacctgggcaagcgcgaggaccagtggtgcggcagcctcatcgggctgaccgcccgggccacctgggccacgaacatccaggtggccatcaaccaggtgcgccgcctgatcggcaacgagaactacctcgactacatgacctccatgaagcggttcaagaacgagagcgacccggagggggcgctgtggtga

SEQ ID NO: 8696 - RNA, 9879 nt, synthetic construct
  misc_feature 1..9879: note = derived and/or modified CDS sequence (opt1) from DENV-1__GU131797__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgcggggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcatggggcagctgacctggaacgacctgatccgcctctgcatcatggtcggcgccaacgcgagcgaccggatggggatgggcaccacctacctggccctgatggccacgttcaagatgcgcccgatgttcgccgtgggcctcctgttccggcgcctgacctcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactgcgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgcgacgacaccctgaccatcctcctgaaggcgacgctgctcgccgtgtccggcgtgtacccgctgagcatccccgccaccctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacgcgcggcgccgtcctcatgtaccaggggaagcggctggagcccagctgggcgtccgtgaagaaggacctgatcagctacggcggcgggtggcgcctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctgtacggcaacggggtcgtgaccaccagcggcacgtacgtgagcgcgatcgcccaggccaaggcctcccaggaggggccgctccccgagatcgaggacgaggtcttccgcaagcggaacctgaccatcatggacctgcaccccggcagcgggaagacccgccggtacctcccggcgatcgtgcgcgaggccatcaagcgcaagctgcggaccctgatcctcgcccccacgcgcgtggtcgcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtcgaggcgttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccgcggcgctgcctgaagcccgtgatcctgaaggacgggcccgagcgggtcatcctcgccggccccatgccggtgaccgtcgcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtctccggggacctgatcctcgagatcggcaagctgccgcagcacctgacccagcgggcccagaacgccctcgacaacctggtgatgctgcacaacagcgagcagggcgggcgcgcctaccggcacgcgatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcctccgtcgagccccactggatcgcggccagcatcatcctggagttcttcctgatggtgctcctgatccccgagccggacaagcagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcggcgggtggagctactactgcgccgggctgaagaaggtgacggaggtcaaggggtacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagcgcgacgtggacctgggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacgggaccgtgatggacgtcatcagccgccgggaccagcgcggctccggccaggtgggcacgtacggcctcaacaccttcaccaacatggaggcccagctgatccggcagatggagagcgaggggatcttctcccccagcgagctggagacccccaacctcgccgagcgcgtgctggactggctggagaagtacggcgtcgagcggctcaagcgcatggccatctccggggacgactgcgtggtgaagccgatcgacgaccggttcgcgacggccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgcgaggaccagtggtgcggcagcctcatcggcctgaccgcccgggccacctgggcgaccaacatccaggtggccatcaaccaggtccgccggctgatcgggaacgagaactacctcgactacatgacctccatgaagcgcttcaagaacgagagcgaccccgagggcgccctgtggtga

SEQ ID NO: 8697 - RNA, 9879 nt, synthetic construct
  misc_feature 1..9879: note = derived and/or modified CDS sequence (opt1) from DENV-1__GU131801__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgagaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcggcatcggcgcgggggagaaggccctcaagctgagctgggtgaagaagggctccagcatcgggaagatggtggaggccaccgcccgcggcgcccggcgcatggcgatcctgggggacacggcctgggacttcggctccatcggcggggtcttcaccagcgtgggcaagctcgtgcaccagatcttcgggaccgcctacggcgtcctgttctccggggtgagctggaccatgaagatcggcatcggcgtgctgctcacgtggctggggctgaactcccgcagcacctccctcagcatgacctgcatcgccgtcggcctggtgaccctgtacctcggggtgatggtccaggccgactccggctgcgtgatcaactggaaggggcgggagctgaagtgcggcagcggcatcttcgtgacgaacgaggtccacacctggaccgagcagtacaagttccaggcggacagcccgaagcgcctgtccgccgccatcgggaaggcctgggaggagggcgtgtgcgggatccggagcgccacccgcctcgagaacatcatgtggaagcagatctccaacgagctgaaccacatcctgctcgagaacgacatgaagttcaccgtggtcgtgggcgacgtggcggggatcctggtccagggcaagaagatgatccggccccagcccatggagtacaagtacagctggaagtcctggggcaaggccaagatcatcggggccgacgtgcagaacagcacgttcatcatcgacggccccaacaccccggagtgccccgacgaccagcgcgcctggaacatctgggaggtggaggactacgggttcggcatcttcaccaccaacatctggctgaagctccgggactcctacacgcaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacctgcatctggcccaagagccacaccctctggtccaacggggtcctggagagcgagatgatcatccccaagatccacggcgggccgatctcccagcacaactaccgccccggctacttcacgcagaccgccgggccctggcacctgggcaagctcgagctggacttcgacctgtgcgagggcaccaccgtggtggtcgacgagcactgcgggaaccggggcccgagcctccgcacgaccaccgtgaccgggaagatcatccacgagtggtgctgccggtcctgcacgctgccgcccctgcgcttccggggcgaggacgggtgctggtacggcatggagatccgccccgtgaaggagaaggaggagaacctcgtcaagagcatggtgagcgccggctccggggaggtggacagcttctccctgggcctgctctgcatcagcatcatgatcgaggaggtcatgcggtcccgctggagccggaagatgctgatgaccgggaccctggccgtgttcttcctcctgatcatgggccagctgacctggaacgacctcatccgcctgtgcatcatggtgggggccaacgcgtccgaccgcatgggcatgggcacgacctacctggccctcatggccaccttcaagatgcggccgatgttcgccgtcgggctgctgttccgccggctcaccagccgcgaggtgctgctgctcacgatcggcctgtccctggtcgccagcgtggagctccccaactccctggaggagctgggggacggcctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtcagcctgttccccctgtgcctctccaccacgagccagaagaccacctggctgcccgtgctgctcgggtccctgggctgcaagccgctgaccatgttcctcatcgcggagaacaagatctgggggcggaagtcctggcccctgaacgagggcatcatggccgtggggatcgtcagcatcctgctctccagcctgctgaagaacgacgtgcccctcgccggccccctgatcgccggcgggatgctgatcgcctgctacgtgatctccggcagctccgcggacctcagcctggagaaggccgccgaggtctcctgggaggaggaggccgagcacagcggggcctcccacaacatcctggtggaggtgcaggacgacggcacgatgaagatcaaggacgaggagcgcgacgacaccctcaccatcctgctgaaggcgaccctcctggccgtcagcggggtgtacccgctgtccatccccgccaccctcttcgtgtggcacttctggcagaagaagaagcagcggagcggcgtcctgtgggacacgcccagcccgcccgaggtggagcgcgccgtgctggacgacggcatctaccggatcatgcagcgcgggctgctcggccggagccaggtcggggtgggcgtgttccaggagaacgtcttccacaccatgtggcacgtgacccgcggggccgtgctgatgtaccagggcaagcggctggagccctcctgggcgagcgtcaagaaggacctcatctcctacggcgggggctggcgcttccaggggagctggaacaccggcgaggaggtccaggtgatcgccgtcgagcccgggaagaaccccaagaacgtgcagacggcccccggcaccttcaagacccccgagggcgaggtgggggccatcgccctggacttcaagcccggcacctccgggagccccatcgtcaaccgggagggcaagatcgtgggcctgtacgggaacggcgtggtcacgaccagcgggacctacgtgtccgcgatcgcccaggccaaggccagccaggagggcccgctccccgagatcgaggacgaggtgttccgcaagcggaacctgaccatcatggacctgcaccccgggtccggcaagacgcgccggtacctcccggcgatcgtccgcgaggccatcaagcggaagctgcgcaccctgatcctcgcccccacccgcgtggtggccagcgagatggccgaggcgctgaagggcatgcccatccggtaccagaccacggccgtcaagtccgagcacaccgggaaggagatcgtggacctgatgtgccacgccaccttcaccatgcgcctcctgagccccgtgcgggtcccgaactacaacatgatcatcatggacgaggcccacttcacggacccctccagcatcgccgcgcgcggctacatctccacccgggtggggatgggcgaggccgccgccatcttcatgaccgccacgccgcccgggagcatggaggcgttcccgcagtccaacgccgtgatccaggacgaggagcgcgacatccccgagcggagctggaactccggctacgagtggatcacggacttccccggcaagaccgtctggttcgtgcccagcatcaaggccgggaacgacatcgccaactgcctgcgcaagaacggcaagcgggtgatccagctctcccgcaagaccttcgacaccgagtaccagaagacgaagaacaacgactgggactacgtcgtgaccaccgacatcagcgagatgggggcgaacttccgggccgaccgcgtgatcgacccgcggcgctgcctgaagcccgtcatcctgaaggacggccccgagcgggtgatcctcgccgggcccatgccggtcaccgtggcctccgccgcgcagcgccggggccgcatcggccggaaccacaacaaggagggggaccagtacatctacatgggccagcccctgaacaacgacgaggaccacgcccactggacggaggccaagatgctgctcgacaacatcaacacccccgaggggatcatccccgccctgttcgagccggagcgcgagaagtccgccgcgatcgacggcgagtaccgcctgcgcggggaggcccgcaagaccttcgtggagctcatgcggcgcggcgacctgcccgtctggctgtcctacaaggtggccagcgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacgtactccgaccccctcgccctgcgcgagttcaaggagttcgcggccgggcggcgcagcgtgtccggcgacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagaccctgatgctgctcgccctgatcgccgtcctgaccggcggggtgaccctcttcttcctgtccgggaaggggctgggcaagaccagcatcgggctcctgtgcgtgatggcctccagcgtcctgctctggatggcgtccgtggagccccactggatcgccgccagcatcatcctggagttcttcctgatggtgctcctgatccccgagccggaccgccagcggacgccccaggacaaccagctggcctacgtcgtgatcggcctcctgttcatgatcctgaccgtggccgcgaacgagatggggctcctggagacgaccaagaaggacctgggcatcgggcacgtcgccgtggagaaccaccaccacgccgccatgctcgacgtggacctgcaccccgcctccgcgtggaccctgtacgccgtcgccaccacgatcatcaccccgatgatgcgccacaccatcgagaacaccacggccaacatcagcctcaccgccatcgcgaaccaggccgccatcctgatgggcctggacaagggctggcccatctccaagatggacatcggggtgcccctcctggccctgggctgctacagccaggtgaaccccctcaccctgaccgcggccgtcctgatgctcgtggcccactacgccatcatcgggccgggcctgcaggccaaggcgacgcgggaggcccagaagcgcaccgccgccgggatcatgaagaaccccaccatcgacggcatcgtggccatcgacctggaccccgtcgtgtacgacgcgaagttcgagaagcagctcggccagatcatgctgctgatcctctgcacctcccagatcctgctgatgcgcacgacctgggccctctgcgagagcatcaccctggccaccgggcccctgacgaccctctgggagggctccccggggaagttctggaacaccaccatcgccgtgagcatggccaacatcttccggggctcctacctggcgggcgccgggctggccttcagcctcatgaagtccctgggcgggggccgccgggggacgggcgcccagggcgagaccctgggggagaagtggaagcgccagctcaaccagctgtccaagagcgagttcaacacctacaagcggtccggcatcatggaggtcgaccgcagcgaggcgaaggaggggctgaagcggggcgagaccacgaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgaccgaggtcaaggggtacaccaagggcggccccgggcacgaggagcccatcccgatggccacgtacggctggaacctcgtgaagctgcactccgggaaggacgtgttcttcatcccgcccgagaagtgcgacaccctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagacgctggagcagatgcagcggaagcacggcgggatgctcgtgcgcaacccgctgtcccggaacagcacccacgagatgtactgggtgtcctgcggcaccgggaacatcgtcagcgcggtgaacatgacctcccgcatgctgctcaaccggttcaccatggcccaccgcaagcccacgtacgagcgcgacgtggacctgggcgccggcacccggcacgtcgccgtggagcccgaggtggccaacctggacatcatcgggcagcgcatcgagaacatcaagcacgagcacaagagcacctggcactacgacgaggacaacccctacaagacctgggcgtaccacggctcctacgaggtcaagccgagcgggtccgccagcagcatggtgaacggcgtcgtgaagctcctgacgaagccctgggacgtgatccccatggtcacccagatcgccatgaccgacaccacgcccttcgggcagcagcgggtgttcaaggagaaggtggacacccgcaccccgaaggccaagcggggcaccgcccagatcatggaggtcacggcgcgctggctgtggggcttcctctcccggaacaagaagccccgcatctgcacccgggaggagttcacccgcaaggtgcggagcaacgccgccatcggggccgtgttcgtcgacgagaaccagtggaactccgcgaaggaggccgtggaggacgaccgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacacggccgggtgggacacccgcatcaccgaggacgacctgcagaacgaggccaagatcaccgacatcatggagccggagcacgcgctcctggccaagtccatcttcaagctgacgtaccagaacaaggtggtccgggtgcagcgccccgccaagaacggcaccgtgatggacgtcatcagccgccgggaccagcgcgggtccggccaggtgggcacctacgggctcaacaccttcacgaacatggaggcccagctgatccggcagatggagagcgagggcatcttcctgcccaacgagctcgagacccccaacctggccgggcgcgtgctggactggctcgagaagtacggcgtcgagcggctgaagcgcatggcgatctccggggacgactgcgtggtgaagccgatcgacgaccggttcgccaccgccctgaccgccctcaacgacatgggcaaggtccgcaaggacatcccccagtgggagcccagcaagggctggaacgactggcagcaggtccccttctgctcccaccacttccaccagctgatcatgaaggacgggcgggagatcgtggtcccgtgccgcaaccaggacgagctggtgggccgggcccgcgtgagccagggggcgggctggtccctccgggagacggcctgcctgggcaagagctacgcccagatgtggcagctgatgtacttccaccgccgggacctccgcctggccgcgaacgccatctgcagcgccgtccccgtggactgggtgcccacctcccggaccacctggagcatccacgcccaccaccagtggatgacgaccgaggacatgctgtccgtctggaaccgcgtgtggatcgaggagaacccctggatggaggacaagacccggatcagctcctgggaggacgtgccgtacctcggcaagcgcgaggaccagtggtgcggcagcctgatcgggctgaccgcccgcgcgacgtgggccaccaacatccaggtcgccatcaaccaggtgcggcgcctcatcggcaacgagaactactccgactacatgaccagcatgaagcggttcaagaacgagtccgagcccgagggggccctgtggtga

SEQ ID NO: 8698 - RNA, 9879 nt, synthetic construct
  misc_feature 1..9879: note = derived and/or modified CDS sequence (opt1) from DENV-1__GU131804__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctggcgccccacgtgggcctcgggctggagacccgcaccgagacctggatgagctccgagggcgcctggaagcagatccagcgggtcgagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggcccgggcctcccaggaggggccgctccccgagatcgaggacgaggtgttccgcaagcggaacctgaccatcatggacctgcaccccggcagcgggaagacccgccggtacctcccggcgatcgtccgcgaggccatcaagcgcaagctgcggaccctgatcctcgcccccacgcgcgtggtggcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtgatcctcgccggccccatgccggtcaccgtggcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtgtccggggacctgatcctcgagatcggcaagctgccgcagcacctgacccagcgggcccagaacgccctcgacaacctggtcatgctgcacaacagcgagcagggcgggcgcgcctaccggcacgcgatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccggcagcgcacgccccaggacaaccagctggcctacgtggtgatcgggctcctgttcatgatcctgaccgtcgccgccaacgagatgggcctcctggagaccaccaagaaggacctggggatcggccacgcggccgtggagaaccaccaccacgccgccatgctcgacgtggacctgcaccccgcctccgcgtggacgctgtacgccgtcgccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtgaaccccctcacgctgaccgcggccgtcctgatgctcgtggcccactacgccatcatcggcccggggctgcaggccaaggcgacccgggaggcccagaagcgcaccgccgccggcatcatgaagaaccccacggtggacgggatcgtcgccatcgacctggaccccgtggtgtacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtcagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggcgaaggagggcctgaagcgcggggagaccaccaagcacgccgtgtcccggggcaccgccaagctccgctggttcgtcgagcggaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccggaccctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgcggtgaacatgacgtcccgcatgctgctcaaccggttcaccatggcccaccgcaagcccacctacgagcgggacgtcgacctgggggccggcacccgccacgtggccgtggagcccgaggtcgccaacatcgacatcatcggccagcggatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctcaccaagccctgggacgtcatccccatggtgacccagatcgccatgacggacaccacccccttcggccagcagcgcgtgttcaaggagaaggtcgacacccggacgccgaaggccaagcgcgggaccgcccagatcatggaggtgaccgcgaagtggctgtggggcttcctgtcccggaacaagaagccccgcatctgcacccgggaggagttcacgcgcaaggtgcggagcaacgccgccatcggcgccgtcttcgtggacgagaaccagtggaactccgcgaaggaggccgtggaggacgagcgcttctgggacctcgtccaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcacggaggacgacctgcagaacgaggcccgcatcaccgacatcatggagccggagcacgcgctgctcgccaagtccatcttcaagctgacctaccagaacaaggtcgtgcgggtgcagcgccccgccaagaacgggaccgtcatggacgtgatcagccggcgcgaccagcggggctccggccaggtggggacgtacggcctgaacaccttcaccaacatggaggcccagctcatccgccagatggagagcgaggggatcttctcccccagcgagctggagacccccaacctggccgagcgggtcctcgactggctggagaagtacggcgtggagcgcctgaagcggatggcgatctccggggacgactgcgtggtcaagccgatcgacgaccgcttcgccacggccctcaccgccctgaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctcgtgggccgcgcccgggtcagccagggggcgggctggagcctgcgcgagaccgcctgcctggggaagtcctacgcccagatgtggcagctcatgtacttccaccggcgcgacctgcggctggccgcgaacgccatctgcagcgccgtgcccgtggactggatccccacctcccgcacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctggggaagcgggaggaccagtggtgcggcagcctgatcggcctcaccgcccgcgcgacctgggccaccaacatccaggtcgccatcaaccaggtgcggcgcctgatcgggaacgagaactacctggactacatgacctccatgaagcggttcaagaacgagagcgaccccgagggcgccctctggtga

SEQ ID NO: 8699 - RNA, 9879 nt, synthetic construct
  misc_feature 1..9879: note = derived and/or modified CDS sequence (opt1) from DENV-1__GU131805__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatgacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagccccgagatccagctgcccgactacggggccctcacgctggactgcagcccccggcccggcctggacttcaacgagatggtcctcctgcccatgaaggagaagtcctggctggtgcacaagcagtggttcctcgacctgccgctgccctggaccagcggggcctccaccagccaggagacctggaaccggaaggacctcctgggcacgttcaagaccgcccacgcgaaggagcaggaggtggtcgtgctgggctcccaggagggggccatgcacaccgccctcaccggcgccacggagatccagaccagcgggaccaccacgatcttcgccggccacctgaagtgccgcctgaagatggacaagctcaccctgaaggggatgtcctacgtgatgtgcaccggcagcttcaagctggagaaggaggtcgcggagacccagcacggcacggtgctcgtgcagatcaagtacgaggggaccgacgccccctgcaagatccccttctccacccaggacgagaagggcgtcacccagaacgggcggctgatcacggccaacccgatcgtgaccgacaaggagaagcccgtgaacatcgaggccgagcccgcgttcggcgagagctacatcgtcatcggcgccggggagaaggccctgaagctgtcctgggtgaagaagggcagctccatcgggaagatgttcgaggccaccgcccgcggcgcgcggcgcatggccatcctcggggacaccgcctgggacttcggcagcatcggcggggtgttcacgtccgtcggcaagctggtgcaccagatcttcgggaccgcctacggcgtgctgttcagcggggtctcctggaccatgaagatcggcatcggcgtgctcctgacctggctggggctcaacagccgctccacgagcctgtccatgacctgcatcgccgtgggcctggtcaccctctacctgggggtgatggtgcaggcggacagcggctgcgtcatcaactggaaggggcgggagctgaagtgcggcagcggcatcttcgggaccaacgaggtgcacacgtggaccgagcagtacaagttccaggccgactcccccaagcgcctcagcgccgccatcggcaaggcctgggaggagggggtgtgcggcatccggtccgcgacccgcctggagaacatcatgtggaagcagatcagcaacgagctgaaccacatcctcctggagaacgccatgaagctgaccgtcgtggtgggggacgtcgccggcatcctcgcccagggcaagaagatgatccggccgcagcccatggagtacaagtactcctggaagtcctgggggaaggcgaagatcatcggcgccgacgtgcagaacacgaccttcatcatcgacgggcccaacacccccgagtgcccggacgaccagcgcgcctggaacatctgggaggtggaggactacggcttcggcatcttcaccaccaacatctggctgaagctgcgggactcctacacgcaggtctgcgaccaccgcctcatgagcgccgccatcaaggactccaaggcggtgcacgccgacatggggtactggatcgagagcgagaagaacgagccctggaagctggcccgggcctccttcatcgaggtgaagacctgcatctggcccaagagccacaccctgtggtccaacggcgtcctcgagagcgagatgatcatcccgaagatctacgggggccccatctcccagcacaactaccgccccgggtacttcacccagacggccggcccctggcacctgggcaagctggagctcgacttcgacctgtgcgaggggaccaccgtggtggtcgacgagcactgcggcaaccgggggccgagcctgcgcaccacgaccgtgcccggcaagatcatccacgagtggtgctgccggtcctgcaccctgccgcccctccgcttcaagggggaggacggctgctggtacggcatggagatcagcccggtgaaggagaaggaggagaacctggtcaagagcatggtgtccgcggggagcggcgaggtggactccttcagcctcgggctgctgtgcatctccatcatgatcgaggaggtcatgcggagccgctggtcccggaagatgctcatgaccggccccctgcccgtgttcttcctgctcatcatggggcagctgccctggaacgacctgatccgcctctgcatcatggtgggcgccaacgccagcgaccggatgggcatggggacgccgtacctggccctgatggccaccttcaagatgcgccccatgttcgcggtcggcctcctgttccgccggctgacctcccgcgaggggctcctgctgaccatcggcctcagcctggtggcctccgtggagctgcccaacagcctcgaggagctgggcgacgggctggccatgggcatcatgatcctcaagctgctgacggacttccagtcccaccagctctgggccaccctgctggcgctcaccttcatcaagaccacgttcagcctggactacgcctggaagaccatggccatggtcctgtccatcgtgagcctcttccccctgtgcctgtccaccaccagccagaagacgacctggctcccggtcctgctggggtccctcggctgcaagcccctgaccatgttcctgatcgccgagaacaagatctgggggcgcaagagctggcccctcaacgagggcatcatggccgtgggcatcgtgagcatcctgctgtccgcgctcctgaagaacgacgtccccctggccgggccgctcatcgccggcgggatgctgatcgcctgctacgtgatcagcggctccagcgccgacctgtccctcgagaaggcggccgaggtgagctgggaggaggaggccgagcactccgggggcagccacaacatcctggtcgaggtgcaggacgacggcaccatgaagatcaaggacgaggagcgcgacgccacgctgaccatcctcctgaaggccaccctgctcgcggtgtccggggtctaccccctgagcatccccgccaccctgttcgtgtggtacttctggcagaagaagaagcagcggtccggcgtgctctgggacacgcccagcccgcccgaggtcgagcgcgccgtgctggacgacgggatctaccggatcatgcagcgcggcctgctggggcggtcccaggtgggcgtcggcgtgttccaggagaacgtgttccacaccatgtggcacgtcacccgcggggccgtgctcatgtaccagggcaagcggctggagcccagctgggcctccgtgaagaaggacctgatcagctacgggggcgggtggcgcctccagggctcctggaacaccggcgaggaggtccaggtgatcgcggtggagccggggaagaaccccaagaacgtccagacggcccccggcaccttcaagaccagcgagggggaggtgggcgccatcgccctggacttcaagcccggcacctccgggagcccgatcgtgaaccgggagggcaagatcgtcgggctgtacggcaacggggtggtgaccacgagcggcacctacgtctccgcgatcgcccaggccaaggccagccaggagggccccctccccgagatcgaggacgaggtgttccgcaagcggaacctgaccatcatggacctgcaccccgggtccggcaagacccgccggtacctcccggccatcgtgcgcgaggcgatcaagcggaagctgcgcacgctgatcctcgcccccacccgggtcgtggccagcgagatggccgaggccctgaaggggatgcccatccgctaccagaccaccgcggtgaagtccgagcacacgggcaaggagatcgtcgacctgatgtgccacgccaccttcaccatgcgcctcctgagccccgtgcgggtgccgaactacaacatgatcatcatggacgaggcccacttcaccgacccctccagcatcgccgcccgcgggtacatctccacgcgggtcggcatgggcgaggcggccgccatcttcatgaccgccacgccgcccgggagcgtggaggcgttcccgcagtccaacgccgtgatccaggacgaggagcgcgacatccccgagcggagctggaactccggctacgagtggatcaccgacttccccgggaagacggtctggttcgtgcccagcatcaagtccggcaacgacatcgccaactgcctgcgcaagaacgggaagcgggtgatccagctcagccgcaagaccttcgacaccgagtaccagaagaccaagaacaacgactgggactacgtcgtgacgaccgacatctccgagatgggcgccaacttccgggccgaccgcgtgatcgacccgcggcgctgcctgaagcccgtcatcctgaaggacggccccgagcgggtgatcctcgcggggcccatgccggtgaccgtcgccagcgccgcccagcgccggggccgcatcgggcggaaccacaacaaggagggcgaccagtacatctacatggggcagcccctgaacaacgacgaggaccacgcccactggaccgaggcgaagatgctgctcgacaacatcaacacgcccgagggcatcatccccgccctgttcgagccggagcgcgagaagtccgccgccatcgacggcgagtaccggctgcgcggggaggcccgcaagaccttcgtggagctcatgcggcgcggcgacctgcccgtctggctgagctacaaggtggcgagcgaggggttccagtactccgaccggcgctggtgcttcgacggcgagcggaacaaccaggtgctcgaggagaacatggacgtcgagatctggaccaaggagggcgagcgcaagaagctgcggccccgctggctggacgcccggacctacagcgacccgctcgccctgcgcgagttcaaggagttcgccgcggggcggcgctccgtgagcggcgacctgatcctcgagatcgggaagctgccccagcacctgacgcagcgggcccagaacgccctcgacaacctggtgatgctgcacaactccgagcagggcgggcgcgcctaccggcacgccatggaggagctccccgacaccatcgagaccctgatgctgctcgcgctgatcgccgtcctgaccggcggcgtgaccctgttcttcctgagcgggcgcggcctggggaagacctccatcggcctcctgtgcgtgatggccagctccgtcctgctctggatggccagcgtggagccccactggatcgccgcgtccatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagacgaccaagaaggacctgggcatcgggcacgtcgccgtggagaaccaccaccacgcggccatgctcgacgtggacctgcaccccgccagcgcctggaccctgtacgccgtcgcgaccacgatcatcaccccgatgatgcggcacaccatcgagaacaccaccgccaacatctccctcacggccatcgccaaccaggcggccatcctgatgggcctggacaaggggtggcccatcagcaagatggacatcggcgtgcccctcctggccctggggtgctactcccaggtgaaccccctcaccctgaccgccgccgtcctgatgctcgtggcgcactacgccatcatcggcccgggcctgcaggccaaggccacccgcgaggcccagaagcggacggcggccgggatcatgaagaaccccaccgtggacggcatcgtcgccatcgacctggaccccgtggtgtacgacgccaagttcgagaagcagctcgggcagatcatgctgctgatcctctgcaccagccagatcctgctgatgcgcaccacgtgggccctctgcgagtccatcaccctggcgaccggccccctgaccacgctctgggagggcagcccggggaagttctggaacaccaccatcgccgtctccatggccaacatcttccgcggcagctacctggccggggcgggcctggccttcagcctcatgaagtccctcgggggcgggcggcgcgggaccggcgcccagggggagacgctgggcgagaagtggaagcggcagctcaaccagctgagcaagtccgagttcaacacctacaagcgcagcgggatcatggaggtggaccggtccgaggccaaggagggcctgaagcgcggcgagaccaccaagcacgccgtgagccgggggacggcgaagctccgctggttcgtcgagcggaacctggtgaagcccgagggcaaggtgatcgacctggggtgcggccgcgggggctggtcctactactgcgccggcctgaagaaggtcaccgaggtgaaggggtacaccaagggcgggcccggccacgaggagcccatcccgatggccacctacgggtggaacctcgtgaagctgcacagcggcaaggacgtcttcttcatcccgcccgagaagtgcgacacgctgctctgcgacatcggcgagtccagccccaacccgaccatcgaggaggggcggaccctgcgcgtgctgaagatggtggagccctggctccggggcaaccagttctgcatcaagatcctgaacccctacatgccctccgtcgtggagaccctggagcagatgcagcgcaagcacgggggcatgctcgtgcggaacccgctgagccgcaactccacgcacgagatgtactgggtcagctgcggcaccgggaacatcgtgtccgccgtgaacatgaccagccggatgctgctcaaccgcttcaccatggcccaccggaagcccacgtacgagcgcgacgtcgacctgggcgcggggacccgccacgtggccgtggagcccgaggtcgccaacctggacatcatcggccagcggatcgagaacatcaagcacgagcacaagtccacctggcactacgacgaggacaacccgtacaagacctgggcctaccacgggagctacgaggtgaagccctccggcagcgccagctccatggtgaacggcgtcgtgaagctcctgacgaagccctgggacgtcatccccatggtgacccagatcgcgatgaccgacaccaccccgttcgggcagcagcgcgtgttcaaggagaaggtcgacacgcggacccccaaggccaagcgcggcaccgcccagatcatggaggtgaccgccaagtggctgtgggggttcctcagccggaacaagaagccccgcatctgcacgcgggaggagttcacccgcaaggtgcggtccaacgcggccatcggcgccgtcttcgtggacgagaaccagtggaacagcgccaaggaggccgtggaggacgagcgcttctgggacctggtccaccgggagcgcgagctgcacaagcaggggaagtgcgcgacctgcgtgtacaacatgatgggcaagcgggagaagaagctcggcgagttcgggaaggccaagggctcccgcgccatctggtacatgtggctgggggcccggttcctggagttcgaggccctcggcttcatgaacgaggaccactggttcagccgcgagaactccctgagcggggtggagggcgagggcctgcacaagctcgggtacatcctgcgggacatctccaagatccccggcgggaacatgtacgcggacgacaccgccggctgggacacgcgcatcaccgaggacgacctgcagaacgaggccaagatcaccgacatcatggagccggagcacgccctcctggccaagagcatcttcaagctgacctaccagaacaaggtcgtgcgggtgcagcgccccgcgaagaacggcacggtcatggacgtgatctcccggcgcgaccagcgcgggagcggccaggtggggacctacggcctcaacaccttcaccaacatggaggcccagctgatccggcagatggagtccgaggggatcttcagcccctccgagctggagacgcccaacctcgccggccgcgtcctggactggctggagaagcacggcgtggagcggctcaagcgcatggccatcagcggggacgactgcgtggtcaagccgatcgacgaccggttcgccgcggccctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtggggcgggcccgcgtcagccagggcgcgggctggtccctgcgggagaccgcctgcctcggcaagagctacgcccagatgtggcagctgatgtacttccaccgccgggacctgcgcctcgccgccaacgcgatctgctccgccgtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctggggaagcgggaggaccagtggtgcggctccctcatcgggctgaccgcccgcgccacctgggcgaccaacatccaggtggccatcaaccaggtgcggcgcctgatcggcaacgagaactacctcgactacatgacgagcatgaagcgcttcaagaacgagtccgaccccgagggcgccctgtggtga

SEQ ID NO: 8700 - RNA, 9879 nt, synthetic construct
  misc_feature 1..9879: note = derived and/or modified CDS sequence (opt1) from DENV-1__GU131806__SS-prME
  source 1..9879: mol_type = other RNA
agcgtgaccatgttcctgatgctcatgcccaccgccctggccttccacctgaccacccggggcggggagccccacatgatcgtcagcaagcaggagcggggcaagagcctcctgttcaagaccagcgccggggtgaacatgtgcaccctgatcgccatggacctcggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgcgacaagcggtccgtggccctggcgccccacgtgggcctcgggctggagacccgcaccgagacctggatgagctccgagggcgcgtggaagcagatccagcgggtcgagacgtgggccctgcgccacccggggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgccccacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgccgctggcctggaccagcgggggcagcacgtcccaggagacctggaaccggcaggacctcgtggtcaccttcaagaccgcccacggcaagaagcaggaggtggtggtcctggggagccaggagggcgccatgcacacggcgctgaccggggccaccgagatccagacctccggcacgaccaccatcttcgccgggcacctcaagtgccgcctgaagatggacaagctgaccctcaagggcatgagctacgtgatgtgcacgggctccttcaagctggagaaggagctggccgagacccagcacgggaccgtgctcgtccagatcaagtacgagggcaccgacgccccctgcaagatccccttcagcacgcaggacgagaagggggtgacccagaacggccggctgatcaccgcgaaccccatcgtgaccgacaaggagaagccggtcaacatcgaggccgagccgcccttcggcgagtcctacatcgtgatcggggccggcgagaaggccctgaagctgagctggttcaagaaggggtccagcatcggcaagatgttcgaggcgacggcccgcggggcccggcgcatggccatcctcggcgacaccgcctgggacttcggctccatcgggggcgtgttcaccagcgtcgggaagctggtgcaccagatcttcggcaccgcgtacggggtgctgttctccggcgtcagctggacgatgaagatcggcatcggggtgctcctgacctggctgggcctcaactcccgcagcacctccctgagcatgacctgcatcgccgtggggctggtcacgctctacctgggcgtgatggtgcaggccgactccgggtgcgtcatcaactggaagggccgggagctgaagtgcggcagcgggatcttcgtgaccaacgaggtgcacacctggaccgagcagtacaagttccaggccgacagccccaagcgcctctccgccgcgatcggcaaggcctgggaggagggggtctgcggcatccggagcgccacccgcctggagaacatcatgtggaagcagatctccaacgagctgaaccacatcctcctggagaacgacatgaagttcacggtggtggtcggggacgtggccggcatcctggcccagggcaagaagatgatccggccgcagcccatggagtacaagtacagctggaagtcctgggggaaggcgaagatcatcggcgccgacgtgcagaacaccaccttcatcatcgacgggcccaacacccccgagtgcccggacgaccagcgcgcctggaacatctgggaggtcgaggactacggcttcggcatcttcacgaccaacatctggctcaagctgcgggacagctacacccaggtgtgcgaccaccgcctgatgtccgccgcgatcaaggacagcaaggccgtgcacgccgacatggggtactggatcgagtccgagaagaacgagacctggaagctcgcccgggccagcttcatcgaggtcaagacgtgcatctggcccaagtcccacaccctgtggagcaacggcgtgctggagtccgagatgatcatccccaagatctacgggggccccatcagccagcacaactaccgcccggggtacttcacccagaccgcgggcccctggcacctcgccaagctggagctggacttcgacctctgcgagggcacgaccgtggtcgtggacgagcactgcgggaaccggggcccctccctgcgcaccaccacggtgaccgggaagatcatccacgagtggtgctgccggagctgcaccctgccgcccctccgcttccggggcgaggacgggtgctggtacggcatggagatccgccccgtcaaggagaaggaggagaacctggtgaagtccatggtgagcgccggcagcggggaggtcgactccttcagcctgggcctcctgtgcatctccatcatgatcgaggaggtgatgcggagccgctggtcccggaagatgctgatgaccgggacgctcgccgtgttcttcctgctgatcatgggccagctcacctggaacgacctgatccgcctgtgcatcatggtcggggccaacgcgagcgaccgcatgggcatgggcaccacctacctcgccctgatggccacgttcaagatgcggcccatgttcgccgtggggctcctgttccgccggctgacctcccgcgaggtgctgctcctgaccatcgggctgagcctcgtcgcctccgtggagctgccgaacagcctggaggagctcggggacggcctggcgatgggcatcatgatcctgaagctcctgaccgacttccagtcccaccagctgtgggccacgctcctgagcctgaccttcatcaagaccaccttctccctccactacgcctggaagacgatggccatggtcctgagcatcgtgtccctgttccccctctgcctgagcaccacctcccagaagaccacgtggctgcccgtgctcctggggagcctgggctgcaagcccctcaccatgttcctgatcgcggagaacaagatctgggggcggcgctcctggccgctgaacgagggcatcatggccgtcgggatcgtgagcatcctcctgagctccctgctcaagaacgacgtgcccctggccggccccctgatcgccggcgggatgctcatcgcctgctacgtcatcagcggctccagcgcggacctgtccctggagaaggccgccgaggtgagctgggaggaggaggccgagcactccgggcccagccacaacatcctcgtggaggtccaggacgacggcccgatgaagatcaaggacgaggagcgggacgacaccctgaccatcctgctcaaggccaccctgctggcggtgtccggggtgtaccccctcagcatccccgccacgctgttcgtctggtacttctggcagaagaagaagcagcgctccggcgtgctgtgggacacccccagcccgcccgaggtggagcgggccgtcctcgacgacggcatctaccgcatcatgcagcgggggctgctgggccgctcccaggtgggggtgggcgtcttccaggagaacgtgttccacaccatgtggcacgtgacccgcggggccgtcctgatgtaccagggcaagcgcctcgagcccagctgggcctccgtgaagaaggacctgatcagctacggcgggggctggcggctgcaggggtcctggaacacgggcgaggaggtgcaggtcatcgcggtggagcccgggaagaacccgaagaacgtgcagaccgcccccggcaccttcaagacccccgagggcgaggtcggggccatcgccctcgacttcaagcccggcacgagcgggtccccgatcgtgaaccgcgagggcaagatcctgggcctgtacgggaacggcgtggtcaccaccagcgggacctacgtgagcgccatcgcgcaggcccgggcctcccaggagggccccctccccgagatcgaggacgaggtgttccgcaagcggaacctgacgatcatggacctgcacccggggagcggcaagacccgccggtacctccccgccatcgtccgcgaggcgatcaagcgcaagctgcggaccctgatcctcgcccccacccgcgtggtggcctccgagatggccgaggccctgaagggcatgcccatccggtaccagacgaccgcggtcaagagcgagcacaccgggaaggagatcgtggacctgatgtgccacgccaccttcacgatgcgcctcctgtccccggtgcgggtccccaactacaacatgatcatcatggacgaggcccacttcaccgaccccagctccatcgccgcccgcggctacatcagcacccgggtggggatgggcgaggcggccgccatcttcatgaccgccacgcccccggggtccgtggaggccttcccccagagcaacgcggtcatccaggacgaggagcgcgacatccccgagcggtcctggaacagcggctacgagtggatcaccgacttccccggcaagaccgtgtggttcgtgccgtccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggccaacttccgggccgaccgcgtcatcgacccccggcgctgcctgaagcccgtgatcctgaaggacggccccgagcgggtgatcctcgcggggccgatgcccgtcacggtggcctccgccgcccagcgccggggccgcatcggccgcaaccacaacaaggagggggaccagtacatctacatgggccagcccctgaacaacgacgaggaccacgcccactggaccgaggcgaagatgctgctcgacaacatcaacacccccgaggggatcatcccggccctgttcgagcccgagcgggagaagtccgccgccatcgacggcgagtaccgcctgcgcggggaggcccgcaagaccttcgtcgagctcatgcggcgcggcgacctgcccgtgtggctgtcctacaaggtggcgagcgagggcttccagtacagcgaccggcgctggtgcttcgacggggagcggaacaaccaggtcctcgaggagaacatggacgtggagatctggacgaaggagggcgagcgcaagaagctgcggccccgctggctggacgcccggacctactccgacccgctcgccctgcgcgagttcaaggagttcgccgccgggcggcgcagcgtgtccggcgacctgatcctcgagatcggcaagctgccccagcacctgacccagcgggcgcagaacgccctcgacaacctggtcatgctgcacaacagcgagcagggcgggcgcgcctaccggcacgccatggaggagctccccgacaccatcgagacgctgatgctgctcgcgctgatcgccgtgctgaccgggggcgtgaccctcttcttcctgtccgggcgcggcctgggcaagaccagcatcgggctcctgtgcgtcatggcctccagcgtgctgctctggatggcctccgtggagccccactggatcgccgcgagcatcatcctggagttcttcctgatggtcctcctgatcccggagcccgaccggcagcgcacgccccaggacaaccagctggcctacgtggtgatcggcctcctgttcatgatcctgacggtcgccgccaacgagatggggctcctggagaccaccaagaaggacctgggcatcgggcacgtggccgtggagaaccaccaccacgcggccatgctcgacgtcgacctgcacccggcctccgcctggaccctgtacgccgtggcgacgaccatcatcacccccatgatgcgccacaccatcgagaacacgaccgccaacatcagcctcaccgccatcgccaaccaggccgcgatcctgatgggcctggacaagggctggcccatctccaagatggacatcggggtgcccctcctggccctgggctgctacagccaggtcaacccgctcaccctgacggccgccgtgctgatgctcgtggcgcactacgccatcatcgggcccggcctgcaggccaaggccacccgggaggcccagaagcgcaccgcggccgggatcatgaagaaccccaccgtcgacggcatcgtggccatcgacctggaccccgtggtctacgacgccaagttcgagaagcagctcggccagatcatgctgctgatcctctgcacgtcccagatcctgctgatgcggaccacctgggccctctgcgagagcatcaccctggcgacggggccgctgaccaccctctgggagggctcccccgggaagttctggaacaccacgatcgccgtgagcatggccaacatcttccgcggctcctacctggccggcgccgggctggcgttcagcctcatgaagtccctgggcgggggccggcgcgggaccggcgcccagggcgagaccctgggggagaagtggaagcggcagctcaaccagctgtccaagagcgagttcaacacctacaagcgctccggcatcatggaggtggaccggagcgaggccaaggaggggctgaagcgcggcgagacgaccaagcacgccgtctcccgggggaccgcgaagctccgctggttcgtggagcggaacctggtgaagcccgagggcaaggtcatcgacctgggctgcgggcgcggcgggtggagctactactgcgccggcctgaagaaggtgaccgaggtgaaggggtacacgaagggcggccccgggcacgaggagccgatccccatggccacctacggctggaacctcgtcaagctgcactccgggaaggacgtgttcttcatcccgcccgagaagtgcgacaccctgctctgcgacatcggcgagagctccccgaaccccaccatcgaggaggggcggacgctgcgcgtgctgaagatggtcgagccctggctccggggcaaccagttctgcatcaagatcctgaacccctacatgccgagcgtggtggagaccctggagcagatgcagcgcaagcacggcgggatgctcgtccggaaccccctgtcccgcaacagcacccacgagatgtactgggtgtcctgcggcaccgggaacatcgtgagcgccgtcaacatgacctcccgcatgctgctcaaccggttcacgatggcccaccgcaagcccacctacgagcgggacgtggacctgggcgcgggcacccgccacgtggccgtcgagcccgaggtggccaacctggacatcatcgggcagcggatcgagaacatcaagcacgagcacaagagcacctggcactacgacgaggacaacccgtacaagacgtgggcctaccacggctcctacgaggtgaagcccagcgggtccgccagcagcatggtcaacggcgtggtcaagctcctgaccaagccctgggacgtgatccccatggtgacccagatcgcgatgaccgacacgaccccgttcgggcagcagcgcgtcttcaaggagaaggtggacacccggacccccaaggccaagcgcggcacggcccagatcatggaggtgaccgccaagtggctgtggggcttcctctcccggaacaagaagccccgcatctgcacccgggaggagttcacccgcaaggtccggagcaacgccgcgatcggggccgtgttcgtggacgagaaccagtggaactccgccaaggaggccgtcgaggacgagcgcttctgggacctggtgcaccgggagcgcgagctgcacaagcagggcaagtgcgcgacgtgcgtgtacaacatgatggggaagcgggagaagaagctcggcgagttcgggaaggccaagggcagccgcgccatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgggacatcagcaagatcccgggcggcaacatgtacgcggacgacaccgccgggtgggacacccgcatcaccgaggacgacctgcagaacgaggcccgcatcacggacatcatggagcccgagcacgccctcctggccaagtccatcttcaagctgacctaccagaacaaggtggtgcgggtccagcgccccgcgaagaacggcaccgtgatggacgtgatcagccggcgcgaccagcgggggtccggccaggtcggcacctacgggctcaacacgttcaccaacatggaggcccagctgatccgccagatggagagcgagggcatcttctcccccagcgagctggagaccccgaacctcgccgagcgggtgctggactggctggagaagtacggggtggagcgcctcaagcggatggccatctccggcgacgactgcgtcgtgaagcccatcgacgaccgcttcgccaccgcgctgacggccctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtcgactggatccccacctcccgcaccacgtggagcatccacgcccaccaccagtggatgaccaccgaggacatgctgtccgtgtggaaccgcgtgtggatcgaggagaacccgtggatggaggacaagacccacatcagctcctggggcgacgtcccctacctgggcaagcgggaggaccagtggtgcggcagcctcatcgggctgacggcccgcgccacctgggccaccaacatccaggtggcgatcaaccaggtgcggcgcctgatcggcaacgagaactacctcgactacatgacctccatgaagcggttcaagaacgagagcgaccccgagggggccctgtggtga

SEQ ID NO: 8701 - RNA, 9879 nt, synthetic construct
  misc_feature 1..9879: note = derived and/or modified CDS sequence (opt1) from DENV-1__GU131807__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagcccgaggtcaccaacccggccgtgctgcggaagctctgcatcgaggcgaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgccaccatcacgccccaggcgcccacgaccgagatccagctcaccgactacggggccctgaccctggactgcagcccgcgcacgggcctcgacttcaacgagatggtcctggtgaccatgaaggagaagtcctggctggtgcacaagcagtggttcctcgacctgcccctgccctggaccagcggggccagcacctcccaggagacgtggaaccggcaggacctcctggtcaccttcaagaccgcccacgccaagaagcaggaggtggtggtcctgggcagccaggagggcgcgatgcacaccgccctcacgggggccaccgagatccagacctccggcaccacgaccatcttcgccgggcacctgaagtgccgcctgaagatggacaagctcaccctgcggggcatgagctacgtgatgtgcaccgggtccttcaagctggagaaggaggtggccgagacgcagcacggcaccgtcctcgtgcagatcaagtacgagggcaccgacgcgccctgcaagatcccgttcagcacccaggacgagaagggggtgacgcagaacggccgcctgatcaccgccaaccccatcgtcaccgacaaggagaagcccgtgaacatcgaggccgagcccccgttcggggagtcctacatcgtgatcggcgccggcgagaaggcgctgaagctgagctggttcaagaaggggtccagcatcggcaagatgttcgaggccaccgcccgcggggcccgccgcatggccatcctcggcgacacggcgtgggacttcgggtccatcggcggcgtcttcaccagcgtggggaagctggtgcaccagatcttcggccccgcctacggggtcctgttctccggcgtgagctggcccatgaagatcgggatcggcgtgctcctgacctggctgggcctcaactcccggagcacctccctgagcatgacgtgcatcgccgtcgggctggtgaccctctacctgggcgtgatggtccaggccgactccgggtgcgtgatcaactggaagggccgcgagctgaagtgcgggagcggcatcttcgtgaccaacgaggtccacacctggacggagcagtacaagttccaggccgacagccccaagcggctctccgcggccatcggcaaggcctgggaggagggggtgtgcggcatccgcagcgccacccggctggagaacatcatgtggaagcagatctccaacgagctgaaccacatcctcctggagaacgacatgaagttcaccgtggtcgtgggggacgtggccggcatcctggcgcaggggaagaagatgatccgcccgcagcccatggagtacaagtacagctggaagtcctggggcaaggccaagatcatcggcgccgacgtccagaacaccaccttcatcatcgacgggcccaacacgcccgagtgcccggacgaccagcgggcctggaacatctgggaggtggaggactacggcttcgggatcttcaccaccaacatctggctcaagctgcgcgacagctacacccaggtgtgcgaccaccggctgatgtccgcggccatcaaggacagcaaggccgtccacgccgacatgggctactggatcgagtccgagaagaacgagacgtggaagctcgcccgcgcgagcttcatcgaggtgaagacctgcatctggcccaagtcccacaccctgtggagcaacggcgtgctggagtccgagatgatcatccccaagatctacgggggcccgatcagccagcacaactaccggcccgggtacttcacccagacggccggcccctggcacctcgggaagctggagctggacttcgacctctgcgagggcaccaccgtcgtggtggacgaccactgcggcaaccgcgggccctccctgcggaccacgaccgtcaccggcaagatcatccacgagtggtgctgccgcagctgcaccctgccgcccctccggttccgcggggaggacggctgctggtacgggatggagatccggcccgtgaaggagaaggaggagaacctggtgaagtccatggtcagcgccggcagcggcgaggtggactccttcagcctggggctcctgtgcatctccatcatgatcgaggaggtgatgcgcagccggtggtcccgcaagatgctgatgacgggcaccctcgccgtcttcttcctgctgatcatggggcagctcacctggaacgacctgatccgcctgtgcatcatggtgggcgccaacgcgagcgaccggatggggatgggcaccacgtacctcgccctgatggccaccttcaagatccgccccatgttcgccgtggggctcctgttccggcgcctgacctcccgggaggtcctgctcctgaccatcgggctgagcctcgtggcctccgtcgagctgccgaacagcctggaggagctcggcgacgggctggcgatgggcatcatgatcctgaagctcctgacggacttccagtcccaccagctgtgggccaccctcctgagcctgaccttcatcaagaccacgttctccctccactgcgcctggaagaccatggccatggtgctgagcatcgtgtccctgttccccctctgcctgagcaccacctcccagaagacgacctggctgcccgtcctcctgggcagcctggggtgcaagcccctcaccatgttcctgatcgcggagaacaagatctggggccgccggtcctggccgctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgcgacgacacgctgaccatcctgctcaaggcgaccctgctggccgtgtccggcgtctaccccctcagcatcccggccaccctgttcgtgtggtacttctggcagaagaagaagcagcggtccggggtgctgtgggacaccccctccccgcccgaggtcgagcgcgccgtgctcgacgacggcatctaccggatcatgcagcgcggcctgctggggcggtcccaggtgggcgtcggggtgttccaggagaacgtgttccacacgatgtggcacgtcacccgcggcgccgtgctgatgtaccaggggaagcggctcgagccgagctgggcgtccgtgaagaaggacctgatcagctacggcggcgggtggcgcctgcagggctcctggaacaccggggaggaggtccaggtgatcgccgtggagcccggcaagaaccccaagaacgtccagaccgcccccgggacgttcaagaccccggagggcgaggtgggcgccatcgccctcgacttcaagcccgggaccagcggctcccccatcgtgaaccgggaggggaagatcgtcggcctgtacggcaacggggtggtgaccacgagcggcacctacgtcagcgcgatcgcccaggccaaggcctcccaggaggggccgctgcccgagatcgaggacgaggtgttccgcaagcggaacctcaccatcatggacctgcaccccggcagcgggaagacccgccggtacctgcccgcgatcgtgcgcgaggccatcaagcgcaagctccggacgctgatcctggccccgacccgcgtcgtggcctccgagatggccgaggcgctcaagggcatgcccatccggtaccagaccaccgccgtcaagagcgagcacacgggcaaggagatcgtcgacctgatgtgccacgccaccttcaccatgcgcctgctctcccccgtgcgggtgcccaactacaacatgatcatcatggacgaggcccacttcaccgacccgagctccatcgccgcgcgcgggtacatcagcacgcgggtcggcatgggggaggccgccgccatcttcatgaccgccacgccgcccggctccgtggaggcgttcccccagagcaacgccgtgatccaggacgaggagcgcgacatcccggagcggtcctggaacagcgggtacgagtggatcaccgacttccccggcaagacggtctggttcgtgccctccatcaagagcggcaacgacatcgccaactgcctgcgcaagaacgggaagcgggtgatccagctgtcccgcaagaccttcgacaccgagtaccagaagaccaagaacaacgactgggactacgtcgtgacgaccgacatcagcgagatgggcgccaacttccgggcggaccgcgtgatcgacccccggcgctgcctcaagccggtcatcctgaaggacgggcccgagcgggtgatcctggccggccccatgcccgtcaccgtggcctccgccgcccagcgccgggggcgcatcggccgcaaccacaacaaggagggcgaccagtacatctacatggggcagccgctcaacaacgacgaggaccacgcgcactggaccgaggccaagatgctgctggacaacatcaacacgcccgagggcatcatccccgccctcttcgagcccgagcgggagaagtccgccgccatcgacggggagtaccgcctgcggggcgaggcgcgcaagaccttcgtggagctgatgcggcgcggggacctcccggtctggctgtcctacaaggtggccagcgagggcttccagtacagcgaccggcgctggtgcttcgacggcgagaagaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccccagcacctgacgcagcgcgcccagaacgccctggacaacctcgtgatgctgcacaacagcgagcagggcgggcgggcctaccgccacgcgatggaggagctgccggacaccatcgagaccctcatgctgctggccctcatcgccgtcctgaccggcggggtgacgctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggacaagcagcgcacgccccaggacaaccagctggcctacgtcgtgatcgggctcctgttcatgatcctgaccgtggccgccaacgagatgggcctgctcgagaccacgaagaaggacctggggatcggccacgtcgcggtggagaaccaccaccacgccgccatgctggacgtggacctccaccccgcctccgcctggaccctgtacgcggtcgccaccaccatcatcacgcccatgatgcggcacaccatcgagaacaccaccgccaacatcagcctgacggccatcgccaaccaggcggccatcctcatggggctggacaagggctggccgatctccaagatggacatcggcgtgcccctgctcgccctggggtgctacagccaggtgaaccccctgaccctcaccgccgcggtcctgatgctggtggcccactacgccatcatcggccccgggctccaggccaaggccacccgcgaggcgcagaagcgcacggccgccggcatcatgaagaacccgaccgtggacgggatcgtcgccatcgacctggaccccgtggtgtacgacgccaagttcgagaagcagctgggccagatcatgctcctgatcctgtgcacctcccagatcctcctgatgcggaccacgtgggcgctgtgcgagagcatcaccctcgccaccggccccctgaccacgctgtgggaggggtcccccggcaagttctggaacaccaccatcgccgtcagcatggccaacatcttccgcgggtcctacctcgccggcgcgggcctggccttcagcctgatgaagtccctcgggggcgggcggcgcggcaccggggcccagggcgagacgctgggcgagaagtggaagcggcagctgaaccagctctccaagagcgagttcaacacctacaagcgctccgggatcatggaggtggaccggagcgaggccaaggagggcctgaagcgcggggagaccaccaagcacgcggtgtcccggggcacggccaagctgcgctggttcgtcgagcggaacctcgtgaagccggaggggaaggtgatcgacctgggctgcggccgcgggggctggagctactactgcgccgggctgaagaaggtcaccgaggtgaagggctacaccaagggcgggcccggccacgaggagcccatccccatggccacctacgggtggaacctggtgaagctccactccggcaaggacgtcttcttcatcccgcccgagaagtgcgacacgctgctgtgcgacatcggggagagctcccccaaccccaccatcgaggagggccggaccctccgcgtgctgaagatggtggagccgtggctgcgggggaaccagttctgcatcaagatcctcaacccctacatgcccagcgtcgtggagaccctggagcagatgcagcgcaagcacggcggcatgctggtgcggaaccccctctcccgcaacagcacgcacgagatgtactgggtctcctgcgggaccggcaacatcgtgagcgccgtgaacatgacctcccggatgctgctgaaccgcttcaccatggcgcaccgcaagccgacctacgagcgggacgtcgacctcggggccggcacgcgccacgtggccgtggagcccgaggtcgccaacctggacatcatcggccagcggatcgagaacatcaagcacgagcacaagagcacctggcactacgacgaggacaacccctacaagacctgggcctaccacgggtcctacgaggtgaagcccagcggctccgcgagcagcatggtcaacggggtggtgaagctgctcaccaagccgtgggacgtcatccccatggtgacgcagatcgccatgaccgacaccacccccttcggccagcagcgcgtgttcaaggagaaggtcgacacgcggaccccgaaggccaagcgcgggaccgcccagatcatggaggtgaccgccaagtggctgtggggcttcctgtcccggaacaagaagccccgcatctgcacgcgggaggagttcacccgcaaggtgcggagcaacgcggccatcggcgccgtcttcgtggacgagaaccagtggaactccgccaaggaggcggtggaggacgagcgcttctgggacctcgtccaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacgcgcatcaccgaggacgacctgcagaacgaggcccggatcaccgacatcatggagcccgagcacgccctgctcgcgaagtccatcttcaagctgacctaccagaacaaggtcgtgcgcgtgcagcgcccggccaagaacgggacggtcatggacgtgatcagccggcgcgaccagcggggctccggccaggtgggcacctacggcctgaacaccttcaccaacatggaggcccagctcatccgccagatggagagcgaggggatcttctcccccagcgagctggagacgcccaacctggccgagcgggtcctcgactggctggagaagtacggcgtggagcgcctgaagcggatggccatctccggggacgactgcgtggtcaagcccatcgacgaccgcttcgcgaccgccctcaccgccctgaacgacatgggcaaggtgcggaaggacatcccgcagtgggagcccagcaaggggtggaacgactggcagcaggtccccttctgctcccaccacttccaccagctgatcatgaaggacggccgcgagatcgtcgtgccctgccggaaccaggacgagctcgtgggccgcgcccgggtcagccagggggccggctggagcctgcgcgagaccgcgtgcctggggaagtcctacgcccagatgtggcagctcatgtacttccaccggcgcgacctgcggctggccgccaacgcgatctgcagcgccgtgccggtggactggatccccacgtcccgcaccacctggagcatccacgcccaccaccagtggatgaccacggaggacatgctctccgtctggaaccgggtgtggatcgaggagaacccctggatggaggacaagacccacatcagctcctggggcgacgtgccctacctggggaagcgcgaggaccagtggtgcggcagcctgatcggcctcaccgcccgcgccacctgggcgacgaacatccaggtcgccatcaaccaggtgcggcgcctgatcgggaacgagaactacctggactacatgacctccatgaagcggttcaagaacgagagcgacccggagggcgccctctggtga

SEQ ID NO: 8702 - RNA, 9879 nt, synthetic construct
  misc_feature 1..9879: note = derived and/or modified CDS sequence (opt1) from DENV-1__GU131811__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggggagttctgcgaggacaccatgacctacaagtgcccccgcatcaccgaggccgagcccgacgacgtggactgctggtgcaacgccaccgacacgtgggtgacctacgggacctgcagccagatcggggagcaccggcgcgacaagcggtccgtggccctggcgccccacgtgggcctcgggctggagacccgcacggagacctggatgagctccgagggcgcctggaagcagatccagcgggtggagacctgggccctgcgccaccccgggttcaccgtgatcgccctcttcctggcgcacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggccaaggacaagcccaccctggacatcgagctgctcaagaccgaggtcacgaaccccgcggtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgcgaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggtgacccagaacggccggctgatcaccgccaacccgatcgtgacggacaaggagaagcccgtcaacatcgaggccgagccgcccttcggggagagctacatcgtgatcggcgtgggcgagaaggcgctgaagctgtcctggttcaagaaggggagctccatcggcaagatgttcgagaccaccgcccgcggggcccggcgcatggccatcctcggcgacaccgcctgggacttcgggagcatcggcggcgtcttcacgtccgtggggaagctggtgcaccagatcttcggcaccgcgtacggggtcctgttcagcggcgtgtcctggaccatgaagatcgggatcggcgtgctcctgacctggctgggcctcaacagccgctccacgagcctgtccatgacctgcatcgccgtcgggctggtgaccctctacctgggcgtgatggtccaggccgacagcgggtgcgtgatcaactggaagggccgggagctgaagtgcgggagcggcatcttcgtgaccaacgaggtccacacgtggaccgagcagtacaagttccaggccgactccccgaagcgcctcagcgccgcgatcggcaaggcctgggaggagggggtgtgcggcatccggtccgccacccgcctggagaacatcatgtggaagcagatcagcaacgagctgaaccacatcctcctggagaacgacatgaagctgaccgtggtcgtgggggacgtggccggcatcctcgcccaggggaagaagatgatccggccccagcccatggagtacaagtactcctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggactcctacacccaggtgtgcgaccaccgcctcatgagcgccgcgatcaaggactccaaggccgtccacgccgacatgggctactggatcgagagcgagaagaacgagacctggaagctggcccgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacgcagaccgcgggcccctggcacctggggaagctggagctcgacttcgacctgtgcgagggcaccaccgtcgtggtggacgagcactgcggcaaccgggggccgagcctgcgcacgaccaccgtcaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtcagcgccggctccggcgaggtggacagcttctccctcgggctgctgtgcatcagcatcatgatcgaggaggtgatgcgctcccggtggagccgcaagatgctcatgaccggcaccctggccgtcttcttcctgctcatcatggggcagctgacctggaacgacctgatccggctctgcatcatggtgggcgccaacgcctccgaccgcatggggatgggcacgacctacctggcgctgatggccaccttcaagatgcgcccgatgttcgccgtgggcctcctgttccggcgcctgaccagccgggaggtcctcctgctgacgatcgggctctccctggtggccagcgtcgagctgcccaactccctcgaggagctgggcgacgggctggccatgggcatcatgatcctcaagctgctgaccgacttccagagccaccagctctgggcgaccctgctgtccatgaccttcatccgcacgaccttcagcctccactacgcctggaagaccatggccatggtgctgtccatcgtgagcctgttccccctctgcctgtccaccacgagccagaagaccacctggctgcccgtcctcctgggctccctggggtgcaagccgctcaccatgttcctgatcgccgagaacaagatctggggccgcaagagctggcccctgaacgaggggatcatggcggtgggcatcgtgagcatcctcctgtccagcctgctcaagaacgacgtccccctggccgggcccctgatcgccggcggcatgctcatcgcctgctacgtgatctccgggagctccgccgacctgagcctggagaaggcggccgtggtctcctgggaggaggaggccgagcacagcggcgcctcccacaacatcctcgtggaggtgcaggacgacgggacgatgaagatcaaggacgaggagcgcgacgacaccctgaccatcctgctcaaggccaccctgctggcggtcagcggcgtgtacccgctctccatccccgccaccctgttcgtgtggtacttctggcagaagaagaagcagcggagcggggtcctgtgggacacgcccagcccgcccgaggtggagcgcgccgtgctcgacgacggcatctaccggatcatgcagcgcggcctgctggggcggagccaggtcggcgtgggggtgttccaggagaacgtcttccacaccatgtggcacgtgacccgcggcgccgtgctgatgtaccaggggaagcggctcgagccctcctgggccagcgtcaagaaggacctgatctcctacggcggcgggtggcgcctgcagggcagctggaacaccggggaggaggtccaggtgatcgcggtcgagcccggcaagaaccccaagaacgtgcagacggcccccgggaccttcaagacctccgagggcgaggtgggcgccatcgccctcgacttcaagcccgggaccagcggcagccccatcgtcaaccgggaggggaaggtggtgggcctgtacggcaacggggtcgtgacgacctccggcacctacgtgagcgccatcgcgcaggccaaggcctcccaggaggggcccctgccggagatcgaggacgaggtcttccgcaagcggaacctcaccatcatggacctgcaccccggcagcgggaagacgcgccggtacctgcccgccatcgtgcgcgaggcgatcaagcggaagctccgcaccctgatcctggccccgacccgcgtggtcgcctccgagatggccgaggccctcaagggcatgcccatccggtaccagaccacggcggtcaagagcgagcacaccggcaaggagatcgtggacctgatgtgccacgccaccttcaccatgcgcctgctctcccccgtccgggtgcccaactacaacatgatcatcatggacgaggcccacttcacggacccgagctccatcgccgcccgcgggtacatcagcacccgggtgggcatgggggaggcggccgccatcttcatgaccgccacgccgcccggctccgtcgaggccttcccccagagcaacgcggtgatccaggacgaggagcgcgacatcccggagcggtcctggaacagcgggtacgagtggatcacggacttccccggcaagaccgtgtggttcgtcccctccatcaagagcggcaacgacatcgccaactgcctgcgcaagaacgggaagcgggtgatccagctgtcccgcaagaccttcgacaccgagtaccagaagacgaagaacaacgactgggactacgtggtcaccaccgacatcagcgagatgggcgccaacttccgggccgaccgcgtgatcgacccccggcgctgcctcaagccggtcatcctgaaggacgggcccgagcgggtgatcctggcgggccccatgcccgtgaccgtcgcctccgccgcccagcgccgggggcgcatcggccggaaccacaacaaggagggcgaccagtacatctacatggggcagccgctcaacaacgacgaggaccacgcccactggacggaggcgaagatgctgctggacaacatcaacacccccgagggcatcatccccgccctcttcgagcccgagcgcgagaagtccgccgccatcgacggggagtaccgcctgcggggcgaggcccgcaagaccttcgtggagctgatgcggcgcggggacctcccggtgtggctgagctacaaggtcgcgtccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacgtactccgaccccctggccctccgcgagttcaaggagttcgccgccggccggcgcagcgtctccggggacctgatcctggagatcggcaagctcccccagcacctgacccagcgggcgcagaacgccctggacaacctcgtgatgctgcacaacagcgagcagggcgggcgcgcctaccggcacgccatggaggagctgccggacaccatcgagaccctcatgctgctggcgctcatcgccgtgctgacgggcggggtcaccctgttcttcctctccggccgcgggctgggcaagaccagcatcggcctgctctgcgtgatggcctccagcgtgctgctgtggatggcctccgtcgagccccactggatcgccgcgagcatcatcctcgagttcttcctgatggtgctgctcatccccgagcccgaccggcagcgcaccccgcaggacaaccagctggcctacgtggtcatcgggctcctgttcatgatcctgaccgtggccgccaacgagatgggcctgctcgagacgaccaagaaggacctggggatcggccacgtggccgtcgagaaccaccaccacgcggccatgctggacgtggacctccaccccgcctccgcctggaccctgtacgccgtggcgaccacgatcatcacccccatgatgcggcacaccatcgagaacaccacggccaacatcagcctgaccgccatcgccaaccaggccgcgatcctcatggggctggacaagggctggccgatctccaagatggacatcggcgtccccctgctcgccctggggtgctacagccaggtgaaccccctgaccctcaccgccgccgtgctgatgctggtcgcgcactacgccatcatcggccccgggctccaggccaaggccacgcgcgaggcccagaagcgcaccgcggccggcatcatgaagaacccgaccgtggacgggatcgtggccatcgacctggaccccgtcgtgtacgacgccaagttcgagaagcagctgggccagatcatgctcctgatcctgtgcacctcccagatcctcctgatgcggacgacctgggccctgtgcgagagcatcaccctcgcgaccggccccctgacgaccctgtgggaggggtcccccggcaagttctggaacaccaccatcgccgtgagcatggccaacatcttccgcgggagctacctcgccggcgccggcctggcgttctccctgatgaagtccctcgggggcgggcggcgcggcacgggggcccagggcgagaccctgggcgagaagtggaagcggcagctgaaccagctctccaagagcgagttcaacacctacaagcgctccgggatcatggaggtcgaccggagcgaggccaaggagggcctgaagcgcggggagaccacgaagcacgccgtgtcccggggcaccgcgaagctgcgctggttcgtggagcggaacctcgtcaagccggaggggaaggtgatcgacctgggctgcggccgcgggggctggagctactactgcgccgggctgaagaaggtgaccgaggtcaagggctacaccaagggcgggcccggccacgaggagcccatccccatggccacgtacgggtggaacctggtgaagctccactccggcaaggacgtgttcttcatcccgcccgagaagtgcgacaccctgctgtgcgacatcggggagagctcccccaaccccaccatcgaggagggccggaccctccgcgtcctgaagatggtggagccgtggctgcgggggaaccagttctgcatcaagatcctcaacccctacatgcccagcgtggtcgagacgctggagcagatgcagcgcaagcacggcggcatgctggtgcggaaccccctctcccgcaacagcacccacgagatgtactgggtgtcctgcgggaccggcaacatcgtcagcgccgtgaacatgacctcccggatgctgctgaaccgcttcaccatggcccaccgcaagccgacgtacgagcgggacgtggacctcggggcgggcacccgccacgtcgccgtggagcccgaggtcgccaacctggacatcatcggccagcggatcgagaacatcaagcacgagcacaagagcacctggcactacgacgaggacaacccctacaagacctgggcctaccacgggtcctacgaggtgaagcccagcggcagcgcctccagcatggtgaacggggtcgtgaagctgctcacgaagccgtgggacgtgatccccatggtcacccagatcgcgatgaccgacaccacgcccttcggccagcagcgcgtgttcaaggagaaggtggacacccggacccccaaggccaagcgcgggaccgcccagatcatggaggtcacggccaagtggctgtggggcttcctgtcccggaacaagaagccgcgcatctgcacccgggaggagttcacccgcaaggtgcggagcaacgccgcgatcggcgccgtgttcgtcgacgagaaccagtggaactccgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacacggccggctgggacacccgcatcaccgaggacgacctgcagaacgaggccaagatcaccgacatcatggagcccgagcacgccctgctcgccaagtccatcttcaagctgacgtaccagaacaaggtggtccgggtgcagcgcccggcgaagaacgggaccgtgatggacgtcatcagccgccgggaccagcgcggctccggccaggtgggcacctacggcctgaacaccttcacgaacatggaggcccagctcatccggcagatggagagcgaggggatcttctcccccagcgagctggagacccccaacctggccggccgcgccctcgactggctggagaagcacggggtggagcggctgaagcgcatggccatctccggcgacgactgcgtcgtgaagcccatcgacgaccggttcgcgaccgccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcccgcgtgtcccagggcgccgggtggagcctgcgggagacggcgtgcctgggcaagtcctacgcccagatgtggcagctcatgtacttccaccgccgggacctgcgcctggccgccaacgcgatctgcagcgccgtgccggtcgactgggtgcccacctcccggaccacctggagcatccacgcccaccaccagtggatgacgaccgaggacatgctctccgtgtggaaccgcgtctggatcgaggagaacccctggatggaggacaagacccacatcagctcctggggcgacgtgccctacctgggcaagcgggaggaccagtggtgcggcagcctgatcgggctcaccgcccgcgccacgtgggcgaccaacatccaggtggccatcaaccaggtccgccggctgctgggcaacgagaactacctcgactacatgacctccatgaagcgcttcaagaacgagagcgacccggagggggccctgtggtga

SEQ ID NO: 8703 - RNA, 9882 nt, synthetic construct
  misc_feature 1..9882: note = derived and/or modified CDS sequence (opt1) from DENV-1__JF937615__SS-prME
  source 1..9882: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggagcgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccgaccccgcggtgctgcggaagctgtgcatcgaggccaagatctccaacaccaccacggacagccgctgccccacccagggcgaggccaccctcgtggaggagcaggacgccaacttcgtctgccggcgcaccttcgtggaccggggctgggggaacggctgcgggctgttcggcaaggggtccctgatgacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgacagcttcaagctggagaaggaggtggcggagacccagcacgggacggtgctcgtccagatcaagtacgagggcaccgacgccccctgcaagatccccttctccacccaggacgagaagggcgtgacccagaacgggcggctgatcacggccaaccccatcgtgaccgacaaggagaagcccgtcaacatcgaggccgagccgcccttcggcgagagctacatcgtgatcggggcgggcgagaaggccctgaagctgtcctggttcaagaagggcagctccatcgggaagatgttcgaggccaccgcccgcggcgcccggcgcatggcgatcctcggggacaccgcctgggacttcggcagcatcgggggcgtgttcacgtccgtcggcaagctggtgcaccagatcttcgggaccgcctacggcgtgctgttcagcggggtctcctggaccatgaagatcggcatcggggtgctcctgacctggctgggcctcaacagccgctccacgagcctgtccatgacctgcatcgccgtgggcctggtcaccctctacctgggggtgatggtgcaggccgacagcggctgcgtcatcaactggaaggggcgggagctgaagtgcggcagcgggatcttcgtgaccaacgaggtgcacacgtggaccgagcagtacaagttccaggcggactccccgaagcgcctcagcgccgccatcggcaaggcctgggaggagggcgtctgcgggatccggtccgccacccgcctggagaacatcatgtggaagcagatcagcaacgagctgaaccacatcctcctggagaacgacatgaagttcaccgtggtggtcggcgacgtggcggggatcctggcccagggcaagaagatgatccggccccagcccatggagtacaagtactcctggaagtcctgggggaaggccaagatcatcggcgccgacgtgcagaacaccacgttcatcatcgacggccccaacaccccggagtgccccgacgaccagcgcgcgtggaacatctgggaggtcgaggactacgggttcggcatcttcaccaccaacatctggctcaagctgcgggactcctacacccaggtgtgcgaccaccgcctgatgagcgccgccatcaaggactccaaggccgtgcacgccgacatggggtactggatcgagagcgagaagaacgagacctggaagctcgcgcgggcctccttcatcgaggtcaagacctgcatctggcccaagagccacaccctgtggtccaacggcgtgctggagagcgagatgatcatccccaagatctacggcgggccgatctcccagcacaactaccgccccggctacttcacgcagaccgccgggccctggcacctcggcaagctggagctggacttcgacctctgcgaggggaccaccgtggtcgtggacgagcactgcggcaaccggggcccgagcctgcgcacgaccaccgtgaccgggaagatcatccacgagtggtgctgccggtcctgcacgctgccgcccctgcgcttcaagggcgaggacgggtgctggtacggcatggagatccggcccgtcaaggagaaggaggagaacctggtcaagagcatggtgagcgccgggtccggcgaggtcgacagcttctccctgggcctcctgtgcatcagcatcatgatcgaggaggtgatgcgctcccggtggagccgcaagatgctgatgaccgggaccctcgccgtgttcttcctgctgatcatgggccagctcacctggaacgacctgatccggctgtgcatcatggtcggggcgaacgcctccgaccgcatgggcatggggacgacctacctcgccctgatggccaccttcaagatgcgcccgatgttcgccgtgggcctcctgttccggcgcctgaccagccgggaggtgctgctcctgacgatcggcctgtccctcgtcgcgagcgtggagctgcccaactccctggaggagctcggggacggcctggccatggggatcatgatcctgaagctcctgatcgacttccagagccaccagctgtgggccaccctcctgtccctgaccttcatcaagaccacgttcagcctccactacgcctggaagaccatggcgatggtcctgtccatcgtgagcctgttccccctcctgcccgtgcacgacctgccgaagaagaccacctggctccccgtcctgctgggctccctcggctgcaagcccctgacgatgttcctgatcgccgagaacaagatctgggggcgcaagagctggcccctcaacgagggcatcatggccgtggggatcgtgtccatcctgctgagcgccctcctgaagaacgacgtcccgctggccggccccctcatcgccggcgggatgctgatcgcctgctacgtgatcagcgggtccagcgccgacctgtccctcgagaaggccgccgaggtgagctgggaggaggaggcggagcactccggggccagccacaacatcctggtcgaggtgcaggacgacggcaccatgaagatcaaggacgaggagcgggacgacaccctgaccatcctcctgaaggccacgctgctcgccgtgtccggggtctaccccctgagcatccccgccaccctgttcgtgtggtacttctggcagaagaagaagcagcgctccggcgtgctctgggacaccccgtccccgcccgaggtcgagcgggcggtgctggacgacgggatctaccgcatcatgcagcggggcctgctgggccgctcccaggtgggggtcggcgtgttccaggagaacgtgttccacaccatgtggcacgtcacccgcggggcggtgctcatgtaccagggcaagcggctggagcccagctgggcctccgtgaagaaggacctgatcagctacgggggcggctggcggctccaggggtcctggaacacgggcgaggaggtccaggtgatcgccgtggagccggggaagaaccccaagaacgtccagaccgcccccggcaccttcaagaccagcgagggggaggtgggcgcgatcgccctggacttcaagcccggcacgtccgggagcccgatcgtgaaccgcgagggcaagatcgtcgggctgtacggcaacggcgtggtgaccacctccgggacctacgtcagcgccatcgcccaggcgaaggccagccaggagggccccctccccgagatcgaggacgaggtgttccggaagcgcaacctgacgatcatggacctgcacccggggtccggcaagacccggcgctacctccccgccatcgtgcgggaggccatcaagcgcaagctgcggaccctgatcctcgcccccacccgcgtcgtggcgagcgagatggccgaggccctgaaggggatgcccatccgctaccagacgaccgccgtgaagtccgagcacaccggcaaggagatcgtcgacctgatgtgccacgccaccttcacgatgcggctcctgagcccggtgcgcgtgcccaactacaacatgatcatcatggacgaggcgcacttcaccgacccctccagcatcgccgcccggggctacatctccacccgcgtcgggatgggcgaggccgccgcgatcttcatgaccgccacgcccccggggagcgtggaggccttcccccagtccaacgccgtgatccaggacgaggagcgggacatccccgagcgcagctggaactccggctacgagtggatcaccgacttccccgggaagaccgtctggttcgtgccgagcatcaagtccggcaacgacatcgcgaactgcctgcggaagaacggcaagcgcgtgatccagctcagccggaagaccttcgacacggagtaccagaagaccaagaacaacgactgggactacgtcgtgaccaccgacatctccgagatgggggccaacttccgcgccgaccgggtgatcgacccccgccggtgcctgaagcccgtcatcctgaaggacggccccgagcgcgtgatcctcgccgggccgatgcccgtcacggtggccagcgcggcccagcggcgcggccggatcgggcgcaaccacaacaaggagggcgaccagtacatctacatgggccagcccctgaacaacgacgaggaccacgcccactggaccgaggccaagatgctgctcgacaacatcaacacccccgaggggatcatcccggccctgttcgagcccgagcgggagaagtccgcggccatcgacggcgagtaccgcctgcgcggggaggcccggaagaccttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggacgaaggagggcgagcggaagaagctgcgcccccggtggctggacgcccgcacctacagcgacccgctcgcgctgcgggagttcaaggagttcgccgccgggcgccggtccgtgagcggcgacctgatcctcgagatcgggaagctgccccagcacctgacccagcgcgcccagaacgcgctcgacaacctggtgatgctgcacaactccgagcagggcggccgggcctaccgccacgccatggaggagctccccgacaccatcgagacgctgatgttcctggccctcatcgccgtcctgaccgggggcgtgaccctgttcttcctcagcgggcggggcctggggaagacctccatcggcctgctctgcgtgatggcgagctccgtcctgctgtggatggccagcgtggagccccactggatcgccgcctccatcatcctcgagttcttcctgatggtgctgctcatcccggagcccgaccgccagcggacgccccaggacaaccagctggcctacgtcgtgatcggcctcctcttcatgatcctgaccgtggcggccaacgagatggggctgctcgagaccaccaagaaggacctgggcatcgggcacgtcgccgtggagaaccaccaccacgccgccatgctggacgtggacctccacccggcgagcgcctggaccctgtacgccgtcgccacgaccatcatcacccccatgatgcgccacaccatcgagaacacgaccgccaacatctccctgaccgcgatcgccaaccaggccgccatcctcatgggcctggacaaggggtggcccatcagcaagatggacatcggcgtgcccctgctcgcgctgggctgctactcccaggtgaacccgctgaccctcacggccgccgtcctgatgctggtggcccactacgccatcatcgggcccggcctccaggcgaaggccacccgggaggcccagaagcgcaccgccgccgggatcatgaagaaccccaccgtggacggcatcgtcgcgatcgacctggaccccgtggtgtacgacgccaagttcgagaagcagctggggcagatcatgctcctgatcctgtgcacgagccagatcctcctgatgcgcaccacctgggccctgtgcgagtccatcaccctcgccacgggcccgctgaccaccctgtgggagggcagccccgggaagttctggaacaccacgatcgccgtctccatggcgaacatcttccggggcagctacctcgccggggccggcctggccttctccctgatgaagtccctcggcgggggccgccgggggaccggcgcgcagggggagaccctgggcgagaagtggaagcgccagctgaaccagctcagcaagtccgagttcaacacctacaagcggagcggcatcatggaggtggaccgctccgaggccaaggaggggctgaagcggggcgagacgaccaagcacgccgtgagccgcgggaccgccaagctgcggtggttcgtcgagcgcaacctcgtgaagcccgagggcaaggtgatcgacctggggtgcggccggggcgggtggtcctactactgcgccggcctgaagaaggtcaccgaggtgaaggggtacacgaagggcgggcccggccacgaggagccgatccccatggcgacctacggctggaacctggtgaagctccacagcgggaaggacgtcttcttcatcccgcccgagaagtgcgacaccctgctgtgcgacatcggcgagtccagcccgaaccccaccatcgaggaggggcgcacgctccgggtgctgaagatggtggagccctggctgcgcggcaaccagttctgcatcaagatcctcaacccctacatgccgtccgtcgtggagaccctggagcagatgcagcggaagcacgggggcatgctggtgcgcaaccccctcagccggaactccacccacgagatgtactgggtcagctgcggcaccgggaacatcgtgtccgccgtgaacatgacgagccgcatgctgctgaaccggttcaccatggcccaccgcaagcccacctacgagcgcgacgtcgacctcggcgccgggacccggcacgtggccgtggagcccgaggtcgcgaacctggacatcatcggccagcgcatcgagaacatcaagcacgagcacaagtccacctggcactacgacgaggacaacccgtacaagacgtgggcctaccacggcagctacgaggtgaagccctccgggagcgcctccagcatggtcaacggcgtggtgaagctgctcaccaagccctgggacgtcatccccatggtgacccagatcgccatgaccgacacgaccccgttcgggcagcagcgggtgttcaaggagaaggtcgacacccgcacccccaaggccaagcggggcacggcgcagatcatggaggtgaccgccaagtggctgtgggggttcctgagccgcaacaagaagccccggatctgcacccgcgaggagttcacccggaaggtgcgctccaacgccgccatcggcgcggtcttcgtggacgagaaccagtggaacagcgccaaggaggccgtggaggacgagcggttctgggacctcgtccaccgcgagcgggagctgcacaagcagggcaagtgcgccacgtgcgtgtacaacatgatggggaagcgcgagaagaagctgggcgagttcgggaaggccaagggctcccgggcgatctggtacatgtggctcggggcccgcttcctggagttcgaggccctgggcttcatgaacgaggaccactggttcagccgggagaactccctcagcggcgtggagggggagggcctgcacaagctggggtacatcctccgcgacatctccaagatcccgggcgggaacatgtacgccgacgacaccgccggctgggacacccggatcaccgaggacgacctgcagaacgaggcgaagatcacggacatcatggagcccgagcacgccctgctcgccaagagcatcttcaagctgacctaccagaacaaggtcgtgcgcgtgcagcggcccgccaagaacggcaccgtcatggacgtgatctcccgccgcgaccagcgggggagcggccaggtggggacctacggcctgaacacgttcaccaacatggaggcccagctcatccgccagatggagtccgagggcatcttcagcccctccgagctggagaccccgaacctggcggggcgggtcctcgactggctggagaagcacggcgtggagcgcctgaagcggatggccatcagcggggacgactgcgtggtcaagcccatcgacgaccgcttcgccgccgccctcaccgcgctgaacgacatgggcaaggtgcggaaggacatcccccagtgggagccctccaaggggtggaacgactggcagcaggtcccgttctgcagccaccacttccaccagctgatcatgaaggacggccgcgagatcgtcgtgccctgccggaaccaggacgagctcgtgggccgcgcccgggtctcccagggggccggctggagcctgcgcgagacggcctgcctgggcaagagctacgcgcagatgtggcagctcatgtacttccaccggcgcgacctgcggctggccgccaacgccatctgctccgccgtgcccgtggactgggtccccaccagccgcaccacctggtccatccacgcgcaccaccagtggatgacgaccgaggacatgctcagcgtgtggaaccgggtgtggatcgaggagaacccgtggatggaggacaagacccacatctccagctggggcgacgtcccctacctggggaagcgcgaggaccagtggtgcggctccctgatcggcctcaccgcccgggccacgtgggccaccaacatccaggtggccatcaaccaggtgcgccgcctgatcgggaacgagaactacctggactacatgaccagcatgaagcggttcaagaacgagtccgaccccgagggcgcgctctggtga

SEQ ID NO: 8704 - RNA, 9879 nt, synthetic construct
  misc_feature 1..9879: note = derived and/or modified CDS sequence (opt1) from DENV-1__GU131814__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcacgctcatcctggcccccacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctcaaggacgggcccgagcgcgtgatcctggcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtcatgctccacaacagcgagcagggcgggcgggcctaccgccacgccatggaggagctgcccgacaccatcgagaccctgatgctcctggcgctgatcgccgtgctcaccggcggggtgaccctgttcttcctgtccggccgggggctcggcaagacgagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcggacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcacggggaacatcgtgagcgccgtcaacatgacctcccgcatgctcctgaaccgcttcaccatggcccaccggaagcccacctacgagcgcgacgtggacctgggcgcgggcacgcggcacgtggccgtcgagcccgaggtggccaacctcgacatcatcgggcagcgcatcgagaacatcaagcacgagcacgagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgggtcttcaaggagaaggtggacacgcgcaccccgaaggccaagcggggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtggtgcgcgtccagcggcccgcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccaacctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgaccccgagggggccctgtggtga

SEQ ID NO: 8705 - RNA, 9879 nt, synthetic construct
  misc_feature 1..9879: note = derived and/or modified CDS sequence (opt1) from DENV-1__GU131815__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgacccgcctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggaccagcggggccagcacgtcccaggagacctggaaccgccaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccgcctgatcaccgccaacccgatcgtgaccgacaaggagaagcccgtcaacatcgaggccgagccgcccttcggggagagctacatcacgatcggcgccggcgagaaggcgctcaagctgtcctggttcaagaaggggagctccatcggcaagatgttcgaggccaccgcccgcggggcccgccgcatggccatcctgggcgacaccgcgtgggacttcgggagcatcggcggcgtgttcacctccgtggggaagctcgtccaccagatcttcggcacggcctacggggtgctgttcagcggcgtgtcctggaccatgaagatcgggatcggcgtcctgctcacctggctgggcctgaacagccggtccaccagcctctccatgacgtgcatcgccgtggggctggtgaccctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacgcggctcgagaacatcatgtggaagcagatcagcaacgagctgaaccacatcctgctcgagaacgacatgaagttcaccgtcgtggtgggggacgtcgccggcatcctggcgcaggggaagaagatgatccgcccccagcccatggagtacaagtactcctggaagtcctggggcaaggccaagatcatcggcgccgacgtgcagaacaccaccttcatcatcgacgggcccaacacgccggagtgccccgacgaccagcgggcctggaacatctgggaggtggaggactacggcttcgggatcttcaccaccaacatctggctgaagctccgcgactcctacacccaggtctgcgaccaccggctgatgagcgcggccatcaaggactccaaggccgtgcacgccgacatgggctactggatcgagagcgagaagaacgagacgtggaagctggcccgcgcgtccttcatcgaggtgaagacctgcatctggcccaagagccacaccctctggtccaacggcgtcctggagagcgagatgatcatccccaagatctacgggggcccgatctcccagcacaactaccggcccgggtacttcacccagacggccggcccctggcacctggggaagctcgagctggacttcgacctgtgcgagggcaccaccgtggtggtcgacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtgaaggagaaggaggagaacctcgtcaagagcatggtgtccgccggcagcggcgaggtggacagcttctccctggggctgctctgcatcagcatcatgatcgaggaggtcatgcgctcccggtggagccgcaagatgctgatgacgggcaccctggccgtgttcttcctcctgatcatggggcagctgacctggaacgacctcatccgcctgtgcatcatggtgggcgccaacgcgtccgaccggatggggatgggcaccacgtacctggccctcatggccaccttcaagatgcgcccgatgttcgccgtcgggctgctgttccggcgcctcaccagccgggaggtgctgctgctcaccatcgggctgtccctggtggccagcgtcgagctccccaactccctggaggagctgggcgacgggctcgcgatgggcatcatgatcctgaagctgctcacggacttccagagccaccagctgtgggccaccctgctctccctgaccttcatcaagaccacgttcagcctgcactacgcctggaagaccatggccatggtgctctccatcgtcagcctgttccccctgtgcctctccaccaccagccagaagacgacctggctgcccgtgctgctcggctccctggggtgcaagccgctgaccatgttcctcatcgcggagaacaagatctggggccgccggagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgcgacgacaccctcacgatcctgctgaaggcgaccctcctggccgccagcggcgtctacccgctgtccatccccgccaccctcttcgtgtggtacttctggcagaagaagaagcagcggagcggggtgctgtgggacacccccagcccgcccgaggtcgagcgcgccgtgctggacgacggcatctaccggatcatgcagcgcggcctgctcgggcggagccaggtgggcgtcggggtgttccaggagaacgtgttccacacgatgtggcacgtcacccgcggcgcggtgctgatgtaccaggggaagcggctggagccctcctgggccagcgtgaagaaggacctcatctcctacggcggcgggtggcgcctgcagggcagctggaacaccggggaggaggtccaggtgatcgccgtggagcccggcaagaaccccaagaacgtccagaccgcccccgggacgttcaagacccccgagggcgaggtgggcgccatcgcgctggacttcaagcccgggacctccggcagccccatcgtgaaccgggaggggaagatcgtcggcctctacggcaacggggtggtgaccacgtccggcacctacgtcagcgccatcgcccaggccaaggcgagccaggaggggccgctgcccgagatcgaggacgaggtgttccgcaagcggaacctgaccatcatggacctccaccccggctccgggaagacccgccggtacctgccggccatcgtgcgcgaggccatcaagcgcaagctgcggacgctcatcctggcccccacccgcgtcgtggccagcgagatggcggaggccctgaagggcatgcccatccggtaccagaccaccgccgtgaagtccgagcacacgggcaaggagatcgtcgacctcatgtgccacgccaccttcaccatgcgcctgctgagccccgtgcgggtgccgaactacaacatgatcatcatggacgaggcccacttcaccgacccctccagcgtcgcggcccgcgggtacatctccacgcgggtgggcatgggggaggccgccgccatcttcatgaccgcgacgccgcccggcagcgtggaggccttcccgcagtccaacgccgtcatccaggacgaggagcgcgacatccccgagcggagctggaactccgggtacgagtggatcaccgacttccccggcaagacggtgtggttcgtgcccagcatcaagtccggcaacgacatcgccaactgcctccgcaagaacgggaagcgggtcatccagctgagccgcaagaccttcgacaccgagtaccagaagaccaagaacaacgactgggactacgtggtgacgaccgacatctccgagatgggcgcgaacttccgggccgaccgcgtcatcgacccgcggcgctgcctgaagcccgtgatcctcaaggacgggcccgagcgggtgatcctggccggccccatgccggtcaccgtggccagcgccgcgcagcgccgggggcgcatcggccgcaaccacaacaaggagggcgaccagtacatctacatggggcagcccctgaacaacgacgaggaccacgcccactggaccgaggccaagatgctcctggacaacatcaacacgcccgagggcatcatccccgccctgttcgagccggagcgggagaagtccgccgcgatcgacggggagtaccgcctccggggcgaggcccgcaagaccttcgtcgagctgatgcggcgcggggacctgcccgtgtggctcagctacaaggtggcctccgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctacagcgaccccctggccctgcgcgagttcaaggagttcgcggccggccggcgctccgtgagcggggacctcatcctggagatcggcaagctgccgcagcacctcacgcagcgggcccagaacgccctggacaacctggtcatgctccacaactccgagcagggcgggcgcgcgtaccggcacgccatggaggagctgcccgacaccatcgagaccctgatgctcctggccctgatcgccgtgctcaccggcggggtgaccctgttcttcctgagcggccgcgggctcggcaagacgtccatcggcctgctgtgcgtcatggccagctccgtgctcctgtggatggcgagcgtggagccccactggatcgccgcctccatcatcctggagttcttcctcatggtcctgctgatccccgagccggaccggcagcgcacgccccaggacaaccagctcgcctacgtggtgatcgggctgctgttcatgatcctcaccgtcgccgcgaacgagatgggcctgctggagaccacgaagaaggacctcgggatcggccacgtggccgccgagaaccaccaccacgccgccatgctggacgtggacctgcaccccgcgagcgcctggaccctctacgccgtcgccaccaccatcatcacgccgatgatgcgccacaccatcgagaacaccaccgccaacatctccctgacggcgatcgccaaccaggccgccatcctgatggggctcgacaagggctggcccatcagcaagatggacatcggcgtgcccctgctggcgctcgggtgctactcccaggtgaaccccctgaccctgaccgccgccgtcctcatgctggtggcccactacgccatcatcggcccggggctgcaggcgaaggccacccgggaggcccagaagcgcacggccgccggcatcatgaagaaccccaccgtggacgggatcgtcgcgatcgacctcgaccccgtggtgtacgacgccaagttcgagaagcagctgggccagatcatgctgctcatcctgtgcaccagccagatcctgctcatgcggaccacgtgggccctgtgcgagtccatcaccctggccaccggccccctcaccacgctgtgggaggggagcccgggcaagttctggaacaccaccatcgccgtctccatggcgaacatcttccgcgggagctacctggccggcgccggcctcgccttctccctgatgaagtccctcgggggcgggcggcgcgggaccggggcgcagggcgagacgctcggcgagaagtggaagcggcagctgaaccagctgagcaagtccgagttcaacacctacaagcgcagcgggatcatggaggtggaccggtccgaggccaaggagggcctcaagcgcggggagaccaccaagcacgccgtgagccggggcacggccaagctgcgctggttcgtcgagcggaacctggtgaagcccgaggggaaggtgatcgacctgggctgcggccgcgggggctggtcctactactgcgccgggctcaagaaggtcaccgaggtgaagggctacaccaagggcgggcccggccacgaggagcccatcccgatggcgacctacgggtggaacctggtgaagctgcacagcggcaaggacgtcttcttcatcccgcccgagaagtgcgacacgctcctgtgcgacatcggggagtccagccccaacccgaccatcgaggagggccggaccctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggacgggcaacatcgtgtccgccgtgaacatgaccagccgcatgctcctgaaccggttcaccatggcccaccgcaagcccacctacgagcgggacgtcgacctgggggccggcacgcgccacgtggccgtggagcccgaggtcgcgaacctcgacatcatcggccagcggatcgagaacatcaagcacgagcacaagtccacctggcactacgacgaggacaacccctacaagacctgggcctaccacgggagctacgaggtgaagccgtccggcagcgcctccagcatggtgaacggggtcgtgaagctgctgaccaagccctgggacgtcatccccatggtgacgcagatcgccatgaccgacaccacccccttcggccagcagcgcgtgttcaaggagaaggtcgacacgcggaccccgaaggccaagcgcgggaccgcgcagatcatggaggtgaccgccaagtggctctggggcttcctgagccggaacaagaagccccgcatctgcacgcgggaggagttcacccgcaaggtgcggtccaacgccgccatcggcgcggtcttcgtggacgagaaccagtggaacagcgccaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggccaaggggtcccgcgcgatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacaccgccggctgggacacgcgcatcaccgaggacgacctccagaacgaggcgcgcatcaccgacatcatggagccggagcacgccctgctggccaagagcatcttcaagctcacctaccagaacaaggtcgtgcgggtgcagcgccccgccaagaacgggacggtcatggacgtgatctcccggcgcgaccagcggggcagcggccaggtgggcacctacggcctgaacaccttcaccaacatggaggcccagctgatccgccagatggagtccgaggggatcttcagcccctccgagctcgagacgcccaacctggcggagcgggtcctggactggctcgagaagtacggcgtggagcgcctgaagcggatggccatcagcggggacgactgcgtggtcaagccgatcgacgaccgcttcgccaccgccctgaccgccctcaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctggtgggccgcgcgcgggtctcccagggggccggctggagcctccgcgagaccgcctgcctgggcaagagctacgcccagatgtggcagctgatgtacttccaccggcgcgacctccggctggcggccaacgccatctgctccgccgtgcccgtggactggatccccacgagccgcaccacctggtccatccacgcccaccaccagtggatgaccacggaggacatgctgagcgtctggaaccgcgtgtggatcgaggagaacccctggatggaggacaagacccacatctccagctggggcgacgtgccgtacctcgggaagcgggaggaccagtggtgcggctccctgatcggcctgaccgcgcgcgccacctgggccaccaacatccaggtcgccatcaaccaggtgcggcgcctcatcgggaacgagaactacctggactacatgacgagcatgaagcggttcaagaacgagtccgaccccgagggcgccctgtggtga

SEQ ID NO: 8706 - RNA, 9879 nt, synthetic construct
  misc_feature 1..9879: note = derived and/or modified CDS sequence (opt1) from DENV-1__GU131818__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtggagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcacctcctacgtcatgtgcacggggagcttcaagctggagaaggaggtggcggagacccagcacggcaccgtgctcgtccagatcaagtacgagggcaccgacgccccctgcaagatccccttctccacgcaggacgagaagggggtgacccagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccacggcccgcggggcccgccggatggcgatcctcggcgacaccgcctgggacttcgggagcatcggcggcgtgttcacctccgtcgggaagctggtgcaccagatcttcggcaccgcctacggggtgctgttcagcggcgtctcctggacgatgaagatcgggatcggcgtgctcctgacctggctgggcctcaacagccgctccaccagcctgtccatgacctgcatcgccgtggggctggtcacgctctacctgggcgtgatggtgcaggccgacagcgggtgcgtcatcaactggaagggccgcgagctgaagtgcgggagcggcatcttcgtgaccaacgaggtgcacacctggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcacggtggtggtcggggacgtggcgggcatcctggcccaggggaagaagatgatccgcccccagcccatggagtacaagtactcctggaagtcctggggcaaggccaagatcatcggcgccgacgtgcagaacaccaccttcatcatcgacgggcccaacaccccggagtgccccgacgaccagcgggcgtggaacatctgggaggtcgaggactacggcttcgggatcttcacgaccaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacgtgcatctggcccaagagccacaccctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcacgaccgtggtcgtggacgagcactgcggcaaccgcgggccgagcctgcggaccaccacggtgaccggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcacgctcgccgtgttcttcctgctgatcatggggcagctcacctggaacgacctgatccgcctgtgcatcatggtcggcgcgaacgcctccgaccggatggggatgggcaccacctacctcgccctgatggccacgttcaagatgcgcccgatgttcgccgtggggctcctgttccgccggctgaccagccgcgaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccacgctcctgtccctgaccttcatcaagaccaccttcagcctccactacgcctggaagacgatggcgatggtcctgtccatcgtgagcctgttccccctctgcctgtccaccaccagccagaagaccacgtggctgcccgtgctcctgggctccctggggtgcaagccgctcaccatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgcgacgacaccctgaccatcctgctcaaggccacgctgctggccgtgagcggcgtgtacccgctctccatccccgccaccctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacgcgcggcgcggtcctgatgtaccaggggaagcggctcgagccctcctgggccagcgtgaagaaggacctgatctcctacggcggcgggtggcgcctgcagggcagctggaacaccggggaggaggtgcaggtcatcgccgtggagcccggcaagaaccccaagaacgtgcagaccgcccccgggaccttcaagacgtccgagggcgaggtcggcgccatcgcgctcgacttcaagcccgggaccagcggcagccccatcgtgaaccgggaggggaagatcgtgggcctgtacggcaacggggtcgtgaccacctccggcacgtacgtgagcgccatcgcccaggccaaggcgtcccaggaggggcccctgccggagatcgaggacgaggtcttccgcaagcggaacctcaccatcatggacctgcaccccggcagcgggaagacccgccggtacctgcccgccatcgtgcgcgaggccatcaagcggaagctccgcaccctgatcctggccccgacgcgggtggtcgcctccgagatggcggaggccctcaagggcatgcccatccgctaccagaccaccgccgtcaagagcgagcacaccggcaaggagatcgtggacctgatgtgccacgccacgttcaccatgcgcctgctctcccccgtccgggtgcccaactacaacatgatcatcatggacgaggcccacttcaccgacccgagctccatcgcggcccgcgggtacatcagcacccgggtgggcatgggggaggccgccgccatcttcatgacggcgacgccgcccggctccgtcgaggccttcccccagagcaacgccgtgatccaggacgaggagcgcgacatcccggagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagacgttcgacaccgagtaccagaagaccaagaacaacgactgggactacgtggtcaccacggacatcagcgagatgggcgcgaacttccgggccgaccgcgtgatcgacccccggcgctgcctcaagccggtgatcctgaaggacgggcccgagcgggtcatcctggccggccccatgcccgtgaccgtcgcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccggctgcgcggcgaggcccgcaagacgttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacctactccgaccccctggccctccgcgagttcaaggagttcgcggccggccggcgcagcgtctccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacacgatcgagaccctcatgctgctggccctcatcgccgtgctgaccggcggggtcaccctgttcttcctctccggccgcgggctgggcaagaccagcatcggcctgctctgcgtgatggcctccagcgcgctgctgtggatggcctccgtggagccccactggatcgccgccagcatcatcctcgagttcttcctgatggtcctgctcatccccgagcccgaccggcagcgcacgccgcaggacaaccagctggcctacgtggtgatcgggctcctcttcatgatcctgaccgtcgcggccaacgagatgggcctgctcgagaccaccaagaaggacctggggatcggccacgtggccgtggagaaccaccaccacgccgccatgctggacgtcgacctccaccccgcgtccgcctggacgctgtacgccgtggccaccaccatcatcacccccatgatgcggcacacgatcgagaacaccaccgccaacatcagcctgaccgcgatcgccaaccaggccgccatcctcatggggctggacaagggctggccgatctccaagatggacatcggcgtgcccctgctcgcgctggggtgctacagccaggtcaaccccctgacgctcaccgccgccgtgctgatgctggtggcccactacgccatcatcggccccgggctccaggcgaaggccacccgcgaggcccagaagcggaccgccgccggcatcatgaagaacccgacggtcgacgggatcgtggcgatcgacctggaccccgtggtctacgacgccaagttcgagaagcagctgggccagatcatgctcctggtgctgtgcacctcccagatcctcctgatgcgcaccacctgggccctgtgcgagagcatcacgctcgccaccggccccctgaccaccctgtgggaggggtcccccggcaagttctggaacacgaccatcgccgtgagcatggcgaacatcttccgcgggagctacctcgccggcgcctccctggccttcagcctgatgaagtccctcggcgggggccggcgcgggaccggcgcgcagggggagaccctgggcgagaagtggaagcggcagctgaaccagctcagcaagtccgagttcaacacgtacaagcgcagcggcatcatggaggtcgaccggtccgaggccaaggaggggctgaagcgcggcgagaccaccaagcacgccgtgagccgggggaccgccaagctgcgctggttcgtggagcggaacctcgtcaagccggagggcaaggtgatcgacctggggtgcggccgcggcgggtggtcctactactgcgccggcctgaagaaggtgacggaggtcaaggggtacaccaagggcgggcccggccacgaggagcccatccccatggcgacctacggctggaacctggtgaagctccacagcgggaaggacgtgttcttcatcccgcccgagaagtgcgacaccctgctgtgcgacatcggcgagtccagccccaaccccacgatcgaggaggggcggaccctccgcgtcctgaagatggtggagccgtggctgcggggcaaccagttctgcatcaagatcctcaacccctacatgccctccgtggtcgagaccctggagcagatgcagcgcaagcacgggggcatgctggtgcggaaccccctcagccgcaactccacccacgagatgtactgggtgagctgcggcaccgggaacatcgtctccgccgtgaacatgacgagccggatgctgctgaaccgcttcaccatggcccaccggaagccgacctacgagcgcgacgtggacctcggcgccgggacccgccacgtcgccgtggagcccgaggtggcgaacctggacatcatcggccagcggatcgagaacatcaagcacgagcacaagtccacgtggcactacgacgaggacaacccctacaagacctgggcctaccacggcagctacgaggtcaagcccagcgggtccgccagctccatggtgaacggcgtcgtgaagctgctcaccaagccgtgggacgtgatccccatggtcacccagatcgccatgacggacaccacccccttcgggcagcagcgcgtgttcaaggagaaggtggacacccggacgcccaaggccaagcgcggcaccgcgcagatcatggaggtcaccgccaagtggctgtgggggttcctgagccggaacaagaagccgcgcatctgcacccgggaggagttcacgcgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggctcccgcgcgatctggtacatgtggctcggggcccggttcctggagttcgaggccctgggcttcatgaacgaggaccactggttcagccgcgagaactccctcagcggcgtggagggggagggcctgcacaagctggggtacatcctccgggacatctccaagatccccggcgggaacatgtacgccgacgacaccgccggctgggacacccgcatcacggaggacgacctgcagaacgaggcgaagatcaccgacatcatggagcccgagcacgccctgctcgccaagagcatcttcaagctgacctaccagaacaaggtggtccgggtgcagcgcccggccaagaacggcaccgtgatggacgtcatctcccggcgcgaccagcgcgggagcggccaggtggggacgtacggcctgaacaccttcaccaacatggaggcccagctcatccggcagatggagtccgaggagatcttcagcccctccgagctggagacccccaacctggcgggccgcgtgctcgactggctggagaagcacggggtcgagcggctgaagcgcatggccatcagcggcgacgactgcgtggtgaagcccatcgacgaccggttcgccacggccctcaccgccctgaacgacatggggaaggtccgcaaggacatcccgcagtgggagcccagcaagggctggaacgactggcagcaggtccccttctgctcccaccacttccaccagctgatcatgaaggacgggcgggagatcgtggtcccctgccgcaaccaggacgagctcgtgggccgggcgcgcgtgagccagggcgccgggtggtccctgaaggagaccgcctgcctgggcaagagctacgcccagatgtggcagctcatgtacttccaccggcgcgacctgcggctggcggccaacgccatctgctccgccgtcccggtggactgggtgcccaccagccgcacgacctggtccatccacgcccaccaccagtggatgaccaccgaggacatgctcagcgtctggaaccgggtgtggatcgaggagaacccctggatggaggacaagacgcacatctccagctggggcgacgtgccctacctgggcaagcgcgaggaccagtggtgcgggtccctgatcggcctcaccgcgcgggccacctgggccaccaacatccaggtcgccatcaaccaggtgcgccggctgatcggcaacgagaactacctggactacatgaccagcatgaagcgcttcaagaacgagtccgacccggagggggccctctggtga

SEQ ID NO: 8707 - RNA, 9879 nt, synthetic construct
  misc_feature 1..9879: note = derived and/or modified CDS sequence (opt1) from DENV-1__GU131820__SS-prME
  source 1..9879: mol_type = other RNA
agcgtgaccatgctgctcatgctgatgcccaccgccctggccttccacctcaccacccggggcggggagccccacatgatcgtgaccaagcaggagcgggggaagtccctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtcacctacgggacctgctcccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcctcggcgaggtcgacagcttctccctggggctgctctgcatcagcatcatgatcgaggaggtgatgcgctcccggtggagccgcaagatgctgatggccggcaccctggccgtgttcctcctgctgatcatggggcagctcacctggaacgacctgatccggctgtgcatcatggtcggcgcgaacgcctccgaccgcatggggatgggcacgacctacctcgccctgatggccaccttcaagatgcgcccgatgttcgccgtgggcctcctgttccggcgcctgaccagccgggaggtgctgctcctgacgatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgaccttcatcaagacgaccctcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcgtggtgtccatcctgctgagcagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggacgatgaagatcaaggacgaggagcgggacgacaccctgaccatcctcctgaaggccaccctgctcgccatcagcggcgtgtacccgctgtccatccccgccaccctgttcgtctggtacttctggcagaagaagaagcagcgcagcggggtgctgtgggacacgcccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgcgaggggaagatcgtgggcctgtacggcaacggggtcgtgacgacctccggcacctacgtgagcgccatcgcccaggccaaggcgagccaggaggggccgctccccgagatcgaggacgaggtcttccggaagcgcaacctgaccatcatggacctgcaccccggctccgggaagacgcggcgctacctcccggccatcgtgcgggaggccatcaagcgcaagctgcggaccctgatcctcgcccccacccgcgtggtcgccagcgagatggcggaggccctgaagggcatgcccatccgctaccagaccacggccgtgaagtccgagcacaccggcaaggagatcgtggacctgatgtgccacgccaccttcaccatgcggctcctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctgcggaagaacgggaagcgcgtgatccagctcagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgggagaagtccgccgcgatcgacggggagtaccgcctgcgcggcgaggcccggaagaccttcgtggagctcatgcgccgcggggacctgcccgtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtcagcggggacctgatcctcgagatcggcaagctgccgcagcacctgacccagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgacgggcggggtcaccctcttcttcctgagcggccgggggctgggcaagacctccatcggcctcctgtgcgtgatggccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccaccatgctcgacgtggacctgcaccccgccagcgcctggaccctgtacgcggtggccacgaccatcatcaccccgatgatgcgccacaccatcgagaacacgaccgccaacatctccctcaccgccatcgccaaccaggcggccatcctgatggggctggacaagggctggcccatcagcaagatggacatcggcgtccccctcctggccctggggtgctactcccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacgggatcgtggccatcgacctggaccccgtcgtgtacgacgccaagttcgagaagcagctcggccagatcatgctgctgatcctctgcacgagccagatcctgctgatgcgcaccacctgggcgctctgcgagtccatcaccctggccacgggccccctgaccaccctctgggaggggagcccgggcaagttctggaacaccacgatcgccgtgtccatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgagcaagtccgagttcaacatctacaagcggagcgggatcatggaggtcgaccgctccgaggccaaggagggcctgaagcgcggggagaccacgcgccacgcggtgagccggggcaccgccaagctgcgctggttcgtggagcggaacctcgtcaagcccgaggggaaggtgatcgacctgggctgcggccgcgggggctggtcctactactgcgccgggctgaagaaggtgaccgaggtcaagggctacaccaagggcgggcccggccacgaggagcccatcccgatggccacgtacgggtggaacctcgtgaagctgcacagcggcaaggacgtgttcttcacgccgcccgagcggtgcgacaccctgctctgcgacatcggggagtccagccccaacccgaccatcgaggagggccgcacgctgcgggtcctgaagatggtggagccctggctccgcgggaaccagttctgcatcaagatcctgaacccctacatgccctccgtggtcgagaccctggagcagatgcagcggaagcacggcggcatgctcgtgcgcaacccgctgagccggaactccacccacgagatgtactgggtgagctgcgggaccggcaacatcgtctccgccgtgaacatgaccagccgcatgctgctcaaccgcttcacgatggcgcaccggaagcccacctacgagcgcgacgtggacctgggggccggcacccggcacgtcgccgtggagcccgaggtggccaacctggacatcatcggccagcgcatcgagaacatcaagcacgagcacaagtccacctggcactacgacgaggacaacccctacaagacgtgggcctaccacgggagctacgaggtcaagccgtccggcagcgcgtccagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcccgctggctgtggggcttcctcagccggaacaagaagccccgcatctgcacccgggaggagttcacccgcaaggtgcggtccaacgcggccatcggcgccgtgttcgtcgacgagaaccagtggaacagcgccaaggaggcggtggaggacgagcgcttctgggacctggtgcagaaggagcgggagctgcacaagcaggggaagtgcgccacgtgcgtctacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccgggggcaacatgtacgccgacgacaccgccggctgggacacccggatcaccgaggacgacctgcagaacgaggccaagatcacggacatcatggagccggagcacgccctcctggcgaccagcatcttcaagctgacctaccagaacaaggtggtccgcgtgcagcgccccgccaagaacgggaccgtgatggacgtcatctcccggcgcgaccagcggggcagcggccaggtgggcacgtacggcctcaacaccttcaccaacatggaggcccagctgatccgccagatggagtccgaggggatcttcctgcccagcgagctcgagacccccaacctggccgagcgggtgctggactggctcgagaagcacggcgtcgagcgcctgaagcggatggccatctccggggacgactgcgtggtgaagccgatcgacgaccgcttcgcgacggccctgaccgccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcccgggtgagccagggggccggctggtccctccgcgagaccgcgtgcctgggcaagagctacgcccagatgtggcagctgatgtacttccaccggcgcgacctccggctggccgccaacgcgatctgcagcgccgtccccgtggactgggtgcccacctcccgcacgacctggagcatccacgcccaccaccagtggatgaccaccgaggacatgctgtccgtctggaaccgggtgtggatcgaggagaacccctggatggaggacaagacgcacgtgagctcctggggcgacgtcccgtacctcgggaagcgcgaggaccagtggtgcggcagcctgatcggcctgaccgcccgcgccacctgggcgtccaacatccaggtggccatcaaccaggtgcggcgcctcatcgggaacgagaactacctggactacatgaccagcatgaagcggttcaagaacgagggcgaccccgagggggccctgtggtga

SEQ ID NO: 8708 - RNA, 9879 nt, synthetic construct
  misc_feature 1..9879: note = derived and/or modified CDS sequence (opt1) from DENV-1__HM181970__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctgatccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagctcaccgtcgtggtgggggacgtcgcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggccgtcttcttcctcctgatcatgggccagctgacgtggaacgacctcatccgcctgtgcatcatggtgggggcgaacgccttcgaccgcatgggcatgggcaccacctacctggccctcatggccaccttcaagatgcggccgatgttcgccgtggggctgctgttccgccggctcacgagccgcgaggtcctgctgctcaccatcggcctgtccctggtggcgagcgtggagctccccaactccctggaggagctgggggacggcctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtcctgctcgggtccctgggctgcaagccgctgacgatgttcctcatcgccgagaacaagatctgggggcggaagtcctggcccctgaacgagggcatcatggccgtggggatcgtgtccatcctgctcagcagcctgctgaagaacgacgtccccctcgccggccccctgatcgccggcgggatgctgatcgcgtgctacgtgatctccggcagctccgccgacctcagcctggagaaggccgccgaggtgtcctgggaggaggaggccgagcacagcggggcgtcccacaacatcctggtcgaggtgcaggacgacggcaccatgaagatcaaggacgaggagcgcgacgacaccctcaccatcctgctgaaggccaccctcctggccgtgagcggggtctacccgctgtccatccccgccaccctcttcgtgtggtacttctggcagaagaagaagcagcggagcggcgtgctgtgggacacccccagcccgcccgaggtcgagcgcgccgtgctggacgacggcatctaccggatcatgcagcgcgggctgctcggccggagccaggtgggggtcggcgtgttccaggaggacgtgttccacaccatgtggcacgtcacccgcggggcggtgctgatgtaccagggcaagcggctggagccctcctgggccagcgtgaagaaggacctcatctcctacggcgggggctggcgcctgcgggggagctggaacacgggcgaggaggtccaggtgatcgccgtggagcccgggaagaaccccaagaacgtccagaccgcccccggcaccttcaagacccccgagggcgaggtgggggccatcgcgctggacttcaagcccggcacgtccgggagccccatcgtgaaccgcgagggcaagatcgtcggcctctacgggaacggcgtggtgaccacctccgggacctacgtcagcgccatcgcccaggccaaggcgagccaggagggcccgctgcccgagatcgaggacgaggtgttccggaagcgcaacctgacgatcatggacctccaccccgggtccggcaagacccggcgctacctgccggccatcgtgcgggaggccatcaagcgcaagctgcgcaccctcatcctggcccccacccgggtcgtggccagcgagatggcggaggccctgaagggcatgcccatccgctaccagacgaccgccgtgaagtccgagcacaccgggaaggagatcgtcgacctcatgtgccacgccaccttcacgatgcggctgctgagccccgtgcgcgtgccgaactacaacatgatcatcatggacgaggcccacttcaccgacccctccagcatcgcggcccggggctacatctccacccgcgtcgggatgggcgaggccgccgccatcttcatgaccgcgacgccgcccgggagcgtggaggccttcccgcagtccaacgccgtgatccaggacgaggagcgggacatccccgagcgcagctggaactccggccacgagtggatcaccgacttccccggcaagaccgtctggttcgtgcccagcatcaagtccgggaacgacatcgccaactgcctccggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccgcgccggtgcctgaagcccgtcatcctcaaggacggccccgagcgcgtgatcctggccgggcccatgccggtgacggtcgccagcgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtggacggcgagtaccggctccgcggggaggcccggaagaccttcgtcgagctgatgcgccggggcgacctgcccgtgtggctcagctacaaggtggcctccgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctacagcgaccccctggccctgcgggagttcaaggagttcgcggccgggcgccggtccgtgagcggcgacctcatcctggagatcggcaagctgccgcagcacctcacccagcgcgcccagaacgccctggacaacctggtcatgctccacaactccgagcagggcgggcgggcgtaccgccacgccatggaggagctgcccgacaccatcgagacgctgatgctcctggccctgatcgccgtgctcaccgggggcgtgaccctgttcttcctgagcgggcggggcctcggcaagacctccatcgggctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccaccaagaaggacctcggcatcgggcacgtggccgtggagaaccaccaccacgccgccatgctggacgtcgacctgcaccccgccagcgcgtggaccctctacgccgtggccacgaccatcatcaccccgatgatgcgccacaccatcgagaacacgaccgccaacatctccctgaccgccatcgcgaaccaggccgccatcctgatgggcctcgacaagggctggcccatcagcaagatggacatcggggtgcccctgctggccctcggctgctactcccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgagccagatcctgctcatgcgcaccacctgggccctgtgcgagtccatcaccctggccacggggcccctcaccaccctgtgggagggcagcccggggaagttctggaacaccacgatcgccgtgtccatggccaacatcttccggggcagctacctggcgggcgccgggctcgccttctccctgatgaagtccctgggcgggggccgccgggggaccggcgcccagggcgagaccctcggggagaagtggaagcgccagctgaaccagctgagcaagtccgagttcaacacctacaagcggagcggcatcatggaggtggaccgctccgaggcgaaggaggggctcaagcggggcgagacgaccaagcacgccgtcagccgcgggaccgccaagctgcggtggttcgtggagcgcaacctggtgaagcccgagggcaaggtcatcgacctgggctgcgggcggggcgggtggtcctactactgcgccggcctcaagaaggtgaccgaggtgaaggggtacacgaagggcggccccgggcacgaggagcccatcccgatggccacctacggctggaacctggtcaagctgcacagcgggaaggacgtgttcttcatcccgcccgagaagtgcgacaccctcctgtgcgacatcggcgagtccagccccaacccgaccatcgaggaggggcgcacgctgcgggtgctcaagatggtcgagccctggctgcgcggcaaccagttctgcatcaagatcctgaacccctacatgccctccgtggtggagaccctcgagcagatgcagcggaagcacggcgggatgctggtccgcaacccgctgagccggaactccacccacgagatgtactgggtgagctgcggcaccgggaacatcgtgtccgcggtcaacatgaccagccgcatgctcctgaaccgcttcacgatggcccaccggaagcccacctacgagcgcgacgtggacctgggcaccggcacccggcacgtggccgtcgagcccgaggtggccaacctcgacatcatcgggcagcgcatcgagaacatcaagcacgagcacaagtccacgtggcactacgacgaggacaacccctacaagacctgggcctaccacggcagctacgaggtgaagccgtccgggagcgcgtccagcatggtcaacggcgtggtcaagctgctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcccgctggctctggggcttcctgagccggaacaagaagccccgcatctgcacccgggaggagttcacgcgcaaggtccggtccaacgcggccatcggggccgtgttcgtggacgagaaccagtggaacagcgccaaggaggcggtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggctcccgcgccatctggtacatgtggctgggcgcccggttcctcgagttcgaggcgctggggttcatgaacgaggaccactggttcagccgcgagaactccctgagcggcgtcgagggggagggcctccacaagctggggtacatcctgcgggacatctccaagatccccggcggcaacatgtacgccgacgacaccgccgggtgggacacccgcatcacggaggacgacctccagaacgaggccaagatcaccgacatcatggagccggagcacgccctgctggcgaaggccatcttcaagctcacctaccagaacaaggtggtgcgcgtccagcggcccgccaagaacggcaccgtgatggacgtgatcagccgccgggaccagcgcgggtccggccaggtcggcacgtacgggctgaacaccttcaccaacatggaggcccagctgatccggcagatggagagcgagggcatcttctcccccagcgagctcgagacccccaacctggccgagcgcgcgctggactggctcgagaagtacggggtggagcggctgaagcgcatggccatctccggcgacgactgcgtggtcaagccgatcgacgaccggttcgccacggccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcgcgcgtcagccagggcgccgggtggtccctccgggagaccgcctgcctgggcaagagctacgcccagatgtggcagctgatgtacttccaccgccgggacctccgcctggcggccaacgccatctgcagcgccgtgcccgtggactgggtccccacctcccggacgacctggagcatccacgcccaccaccagtggatgaccaccgaggacatgctgtccgtgtggaaccgcgtgtggatcgaggagaacccctggatggaggacaagacgcacatcagctcctgggaggacgtcccgtacctcgggaagcgcgaggaccagtggtgcggcagcctgatcggcctgaccgcgcgggccacctgggccaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8709 - RNA, 9879 nt, synthetic construct
  misc_feature 1..9879: note = derived and/or modified CDS sequence (opt1) from DENV-1__GU131821__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagaaggtcgagacctgggccctgcggcaccccgggttcacggtgatcgccctcttcctggcgcacgccatcggcaccagcatcacccagaaggggatcatcttcatcctgctcatgctggtgaccccctccatggccatgcgctgcgtcggcatcggcagccgggacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcgcaagctgtgcatcgaggccaagatctccaacaccaccacggacagccggtgcccgacccagggcgaggccaccctcgtggaggagcaggacgccaacttcgtctgccgccggaccttcgtggaccgcggctgggggaacggctgcgggctgttcggcaaggggtccctgatcacgtgcgccaagttcaagtgcgtgaccaagctcgagggcaagaccgtccagcacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccgcaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccggctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccgcctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccgccggatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgcgagctgaagtgcgggagcggcatcttcgtgacgaacgaggtgcacacctggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagttcaccgtggtggtcggggacgtggcgggcatcctggcccaggggaagaagatgatccgcccccagcccatggagtacaagtactcctggaagtcctggggcaaggccaagatcatcggcgccgacgtgcagaacacgaccttcatcatcgacgggcccaacaccccggagtgccccgacgaccagcgggcgtggaacatctgggaggtcgaggactacggcttcgggatcttcaccacgaacatctggctcaagctgcgcgactcctacacccaggtgtgcgaccaccggctgatgagcgccgccatcaaggactccaaggccgtgcacgccgacatgggctactggatcgagagcgagaagaacgagacctggaagctcgcgcgcgcctccttcatcgaggtcaagacctgcatctggcccaagagccacacgctgtggtccaacggcgtgctggagagcgagatgatcatccccaagatctacgggggcccgatctcccagcacaactaccggcccgggtacttcacccagaccgccggcccctggcacctcgggaagctggagctggacttcgacctctgcgagggcaccacggtggtcgtggacgagcactgcggcaaccgcgggccgagcctgcggaccaccaccgtgacgggcaagatcatccacgagtggtgctgccgctcctgcaccctgccgcccctgcggttcaagggggaggacggctgctggtacgggatggagatccgccccgtcaaggagaaggaggagaacctggtcaagagcatggtgagcgccggctccggcgaggtcgacagcttctccctggggctcctgtgcatcagcatcatgatcgaggaggtgatgcggtcccgctggagccggaagatgctgatgaccggcaccctcgccgtgttcttcctgctgatcatggggcagctcacgtggaacgacctgatccgcctgtgcatcatggtcggcgcgaacgcctccgaccggatggggatgggcaccacctacctcgccctgatggccaccttcaagatgcgcccgatgttcgccgtggggctcctgttccgccggctgacgagccgcgaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgcgacgacaccctgaccatcctgctcaaggccaccctgctggccgtgagcggcgtgtacccgctctccatccccgccacgctgttcgtctggtacttctggcagaagaagaagcagcggagcggggtgctgtgggacacccccagcccgcccgaggtggagcgcgccgtcctcgacgacggcatctaccggatcatgcagcgcggcctgctggggcggagccaggtgggcgtgggggtcttccaggagaacgtgttccacaccatgtggcacgtgacccgcggcgcggtcctgatgtaccaggggaagcggctcgagccctcctgggccagcgtgaagaaggacctgatctcctacggcggcgggtggcgcctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgggaggggaagatcgtgggcctgtacggcaacggggtcgtgaccacctccggcacctacgtgagcgccatcgcccaggccaaggcgtcccaggaggggcccctgccggagatcgaggacgaggtcttccgcaagcggaacctcacgatcatggacctgcaccccggcagcgggaagacccgccggtacctgcccgccatcgtgcgcgaggccatcaagcggaagctccgcaccctgatcctggccccgacccgggtggtcgcctccgagatggcggaggccctcaagggcatgcccatccgctaccagacgaccgccgtcaagagcgagcacaccggcaaggagatcgtggacctgatgtgccacgccaccttcacgatgcgcctgctctcccccgtccgggtgcccaactacaacatgatcatcatggacgaggcccacttcaccgacccgagctccatcgcggcccgcgggtacatcagcacccgggtgggcatgggggaggccgccgccatcttcatgaccgcgacgccgcccggctccgtcgaggccttcccccagagcaacgccgtgatccaggacgaggagcgcgacatcccggagcggtcctggaacagcgggtacgagtggatcaccgacttccccggcaagaccgtgtggttcgtcccctccatcaagagcggcaacgacatcgccaactgcctgcgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccccggcgctgcctcaagccggtgatcctgaaggacgggcccgagcgggtcatcctggccggccccatgcccgtgacggtcgcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccggctgcgcggcgaggcccgcaagaccttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggacgaaggagggggagcgcaagaagctccggccccgctggctggacgcccggacctactccgaccccctggccctccgcgagttcaaggagttcgcggccggccggcgcagcgtctccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagacgctcatgctgctggccctcatcgccgtgctgaccggcggggtcaccctgttcttcctctccggccgcgggctgggcaagaccagcatcggcctgctctgcgtgatggcctccagcgcgctgctgtggatggcctccgtggagccccactggatcgccgccagcatcatcctcgagttcttcctgatggtcctgctcatccccgagcccgaccggcagcgcaccccgcaggacaaccagctggcctacgtggtgatcgggctcctcttcatgatcctgacggtcgcggccaacgagatgggcctgctcgagaccaccaagaaggacctggggatcggccacgtggccgtggagaaccaccaccacgccaccatgctggacgtcgacctccaccccgcctccgcgtggacgctgtacgccgtggccaccaccatcatcacccccatgatgcggcacacgatcgagaacaccaccgccaacatcagcctgaccgccatcgcgaaccaggccgccatcctcatggggctggacaagggctggccgatctccaagatggacatcggcgtgcccctgctcgccctggggtgctacagccaggtcaaccccctgacgctcaccgcggccgtgctgatgctggtggcccactacgccatcatcggccccgggctccaggccaaggcgacccgcgaggcccagaagcggaccgccgccggcatcatgaagaacccgacggtcgacgggatcgtggccatcgacctggaccccgtggtctacgacgcgaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtcccccggcaagttctggaacacgaccatcgccgtgagcatggccaacatcttccgcgggagctacctcgcgggcgccggcctggccttctccctgatgaagtccctcgggggcgggcggcgcggcaccggggcccagggcgagaccctgggcgagaagtggaagcggcagctgaaccagctctccaagagcgagttcaacacgtacaagcgctccgggatcatggaggtggaccggagcgaggcgaaggagggcctgaagcgcggggagaccaccaagcacgccgtctcccggggcaccgccaagctgcgctggttcgtggagcggaacctcgtgaagccggaggggaaggtcatcgacctgggctgcggccgcgggggctggagctactactgcgccgggctgaagaaggtgacggaggtgaagggctacaccaagggcgggcccggccacgaggagcccatccccatggccacctacgggtggaacctggtcaagctccactccggcaaggacgtgttcttcatcccgcccgagaagtgcgacaccctgctgtgcgacatcggggagagctcccccaaccccacgatcgaggagggccggaccctccgcgtgctgaagatggtcgagccgtggctgcgggggaaccagttctgcatcaagatcctcaacccctacatgcccagcgtggtggagaccctggagcagatgcagcgcaagcacggcggcatgctggtccggaaccccctctcccgcaacagcacccacgagatgtactgggtgtcctgcgggaccggcaacatcgtgagcgcggtcaacatgacgtcccggatgctgctgaaccgcttcaccatggcccaccggaagccgacctacgagcgcgacgtggacctcggggccggcacccgccacgtggccgtcgagcccgaggtggccaacctggacatcatcggccagcggatcgagaacatcaagcacgagcacaagagcacgtggcactacgacgaggacaacccctacaagacctgggcgtaccacgggtcctacgaggtgaagcccagcggcagcgcctccagcatggtcaacggggtggtcaagctgctcaccaagccgtgggacgtgatccccatggtgacccagatcgccatgacggacaccacccccttcggccagcagcgcgtcttcaaggagaaggtggacacccggacgcccaaggccaagcgcgggaccgcccagatcatggaggtgaccgcgaagtggctgtggggcttcctgtcccggaacaagaagccgcgcatctgcacccgggaggagttcacgcgcaaggtccggagcaacgccgccatcggcgccgtgttcgtggacgagaaccagtggaactccgcgaaggaggccgtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcgcggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgccggctgggacacccgcatcacggaggacgacctgcagaacgaggccaagatcaccgacatcatggagcccgagcacgcgctgctcgccaagtccatcttcaagctgacctaccagaacaaggtggtgcgggtccagcgcccggccaagaacgggaccgtgatggacgtgatcagccggcgcgaccagcgcggctccgggcaggtcggcacgtacggcctgaacaccttcaccaacatggaggcccagctcatccggcagatggagagcgaggggatcttctcccccagcgagctggagacccccaacctggccggccgcgtgctcgactggctggagaagcacggggtggagcggctgaagcgcatggcgatctccggcgacgactgcgtcgtgaagcccatcgacgaccggttcgccacggccctcaccgccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcccgcgtgtcccagggcgcggggtggagcctgcgggagaccgcctgcctgggcaagtcctacgcccagatgtggcagctcatgtacttccaccgccgggacctgcgcctggccgcgaacgccatctgcagcgccgtgccggtcgagtgggtgcccacctcccggacgacctggagcatccacgcccaccaccagtggatgaccaccgaggacatgctctccgtgtggaaccgcgtctggatcgaggagaacccctggatggaggacaagacgcacatcagctcctggggcgacgtgccctacctgggcaagcgggaggaccagtggtgcggcagcctgatcgggctcaccgcccgcgcgacctgggccaccaacatccaggtggccatcaaccaggtccggcgcctgatcggcaacgagaactacctggactacatgacctccatgaagcgcttcaagaacgagagcgacccggagggggccctctggtga

SEQ ID NO: 8710 - RNA, 9879 nt, synthetic construct
  misc_feature 1..9879: note = derived and/or modified CDS sequence (opt1) from DENV-1__JF937617__SS-prME
  source 1..9879: mol_type = other RNA
agcgtgaccatgctgctcatgctgatgcccaccgccctggccttccacctcaccacccggggcggggagccccacatggtggtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctgttctccggcgtcagctggaccatgaagatcgggctgggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacgtgatgtggaagcagatctccaacgagctgaaccacatcctgctcgagaacgacatgaagttcaccgtggtcgtgggggacgtggcgggcatcctggcccaggggaagaagatgatccggccccagcccatggagtacaagtacagctggaagtcctggggcaaggccaagatcatgggcgccgacgtccagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtgtgcgaccaccgcctgatgtccgccgccatcaaggacagcaaggccgtccacgccgacatgggctactggatcgagtccgagaagaacgagacctggaagctggcgcgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtggacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgctggtcccggaagatgctgatgaccggcaccctggtcgtgttcctcctgctgatcatggggcagctcacgtggaacgacctgatccgcctgtgcatcatggtgggcgccaacgcgagcgaccgcatggggatgggcaccacctacctcgccctgatggccaccttcaagatgcggccgatgttcgccgtcgggctcctgttccgccggctgacgtcccgcgaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtgctgagcatcgtctccctgttccccctctgcctgagcacgacctcccagaagaccacctggctgcccgtgctcctgggcagcctggggtgcaagccgctcacgatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggaccatgaagatcaaggacgaggagcgggacgacaccctgaccatcctgctcaaggcgaccctgctggccgtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgagatcggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccgcaccctgatcctggcccccacccgggtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgcggccgtcgggaaccaccaccacgccgccatgctggacgtggacctccaccccgcctccgcgtggaccctgtacgccgtggccacgaccatcatcaccccgatgatgcgccacaccatcgagaacacgaccgccaacatcagcctgaccgccatcgcgaaccaggccgccatcctcatgggcctggacaagggctggcccatctccaagatggacatcggggtccccctgctcgccctgggctgctacagccaggtgaaccccctgaccctcacggcggccgtgctgatgctggtcgcccactacgccatcatcgggccgggcctccaggccaaggcgacccgcgaggcccagaagcggaccgccgccgggatcatgaagaaccccaccgtggacggcatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtgagcatggccaacatcttccggggctcctacctcgcgggcgccgggctggccttcagcctgatgaagtccctcggcgggggccgccgggggaccggcgcccagggcgagaccctgggggagaagtggaagcgccagctgaaccagctctccaagagcgagttcaacacctacaagcggtccggcatcatggaggtcgaccgcagcgaggcgaaggaggggctgaagcggggcgagacgaccaagcacgccgtgtcccgcgggaccgccaagctgcggtggttcgtggagcgcaacctggtcaagcccgagggcaaggtgatcgacctcggctgcgggcggggcgggtggagctactactgcgccggcctgaagaaggtgaccgaggtcaaggggtacacgaagggcggccccgggcacgaggagcccatcccgatggccacctacggctggaacctggtgaagctccactccgggaaggacgtgttcttcatcccgcccgagaagtgcgacaccctgctgtgcgacatcggcgagagctcccccaacccgaccatcgaggaggggcgcacgctccgggtcctgaagatggtggagccctggctgcgcggcaaccagttctgcatcaagatcctcaacccctacatgcccagcgtggtcgagaccctggagcagatgcagcggaagcacggcgggatgctggtgcgcaacccgctctcccggaacagcacccacgagatgtactgggtgtcctgcggcaccgggaacatcgtcagcgcggtgaacatgacctcccgcatgctgctgaaccgcttcacgatggcccaccggaagcccacctacgagcgcgacgtggacctcggcgccggcacccggcacgtcgccgtggagcccgaggtggccaacctggacatcatcgggcagcgcatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctgctcaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgaagtggctgtggggcttcctgtcccgcaacaagaagccccggatctgcacccgcgaggagttcacccggaaggtgcgcagcaacgccgccatcggggccgtgttcgtcgacgagaaccagtggaactccgcgaaggaggccgtggaggacgagcggttctgggacctcgtgcaccgcgagcgggagctgcacaagcagggcaagtgcgccacgtgcgtctacaacatgatggggaagcgcgagaagaagctgggcgagttcgggaaggccaagggcagccgggccatctggtacatgtggctcggcgcgcgcttcctggagttcgaggccctggggttcatgaacgaggaccactggttctcccgggagaacagcctctccggcgtggagggggagggcctgcacaagctggggtacatcctccgcgacatcagcaagatccccggcggcaacatgtacgccgacgacaccgccgggtgggacacccggatcaccgaggacgacctgcagaacgaggcccgcatcacggacatcatggagccggagcacgcgctgctcgccaagtccatcttcaagctgacctaccagaacaaggtggtccgcgtgcagcggcccgccaagaacggcaccgtgatggacgtcatcagccgccgggaccagcgcgggtccggccaggtgggcacctacgggctgaacacgttcaccaacatggaggcccagctcatccggcagatggagagcgagggcatcttctcccccagcgagctggagacccccaacctggccgagcgcgtgctcgactggctggagaagtacggggtcgagcggctgaagcgcatggcgatctccggcgacgactgcgtggtgaagccgatcgacgaccggttcgccaccgccctcacggccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgcggggtggagcctgcgggagaccgcctgcctgggcaagtcctacgcccagatgtggcagctcatgtacttccaccgccgggacctgcgcctggccgcgaacgccatctgcagcgccgtccccgtggactggatccccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctgggcaagcgcgaggaccagtggtgcggcagcctgatcgggctcacggcccgggcgacctgggccaccaacatccaggtggccatcaaccaggtccgccggctgatcggcaacgagaactacctggactacatgacctccatgaagcgcttcaagaacgagagcgaccccgagggggccctctggtga

SEQ ID NO: 8711 - RNA, 9879 nt, synthetic construct
  misc_feature 1..9879: note = derived and/or modified CDS sequence (opt1) from DENV-1__JF937618__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaacccccgcaacgtgcagaccacccccgggacgttcaagacccccgagggcgaggtgggcgccatcgccctggacttcaagcccgggaccagcggctcccccatcgtcaaccgggaggggaagatcgtgggcctctacggcaacggggtggtcaccacgagcggcacctacgtgagcgccatcgcgcaggccaaggcctcccaggaggggccgctgcccgagatcgaggacgaggtgttccgcaagcggaacctgaccatcatggacctccaccccggcagcgggaagacccgccggtacctgccggccatcgtccgcgaggcgatcaagcgcaagctgcggacgctcatcctggcccccacccgcgtggtggcctccgagatggccgaggccctgaagggcatgcccatccggtaccagaccaccgcggtcaagagcgagcacacgggcaaggagatcgtggacctcatgtgccacgccaccttcaccatgcgcctgctgtcccccgtgcgggtcccgaactacaacatgatcatcatggacgaggcccacttcaccgaccccagctccatcgccgcccgcgggtacatcagcacgcgggtgggcatgggggaggcggccgccatcttcatgaccgccacgccgcccggctccgtggaggccttcccgcagagcaacgcggtcatccaggacgaggagcgcgacatccccgagcggtcctggaacagcgggtacgagtggatcaccgacttccccggcaagacggtgtggttcgtgccctccatcaagagcggcaacgacatcgccaactgcctccgcaagaacgggaagcgggtcatccagctgtcccgcaagaccttcgacaccgagtaccagaagaccaagaacaacgactgggactacgtggtgacgaccgacatcagcgagatgggcgccaacttccgggccgaccgcgtcatcgacccgcggcgctgcctgaagcccgtgatcctcaaggacgggcccgagcgggtgatcctggcgggccccatgccggtcaccgtggcctccgccgcccagcgccgggggcgcatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgggagaagtccgccgccatcgacggggagtaccgcctccggggcgaggcccgcaagaccttcgtcgagctgatgcggcgcggggacctgcccgtgtggctctcctacaaggtggcgagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctactccgaccccctggccctgcgcgagttcaaggagttcgccgccggccggcgcagcgtgtccggggacctcatcctggagatcggcaagctgccgcagcacctcacgcagcgggcgcagaacgccctggacaacctggtcatgctccacaacagcgagcagggcgggcgcgcctaccggcacgccatggaggagctgcccgacaccatcgagaccctgatgctcctggcgctgatcgccgtgctcaccggcggggtgaccctgttcttcctgtccggccgcgggctcggcaagacgagcatcggcctgctgtgcgtcatggcctccagcgtgctcctgtggaccgcctccgtggagccccactggatcgccgcgagcatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagacgaccaagaaggacctcgggatcggccacgtggccgtggggaaccaccaccacgcggccatgctggacgtcgacctgcaccccgcctccgcctggaccctctacgccgtggcgaccacgatcatcaccccgatgatgcgccacaccatcgagaacaccacggccaacatcagcctgaccgccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacgcgggaggcccagaagcgcaccgcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcggacgacctgggccctgtgcgagagcatcaccctggcgaccgggcccctcacgaccctgtgggagggctccccggggaagttctggaacaccaccatcgccgtgagcatggccaacatcttccgcggctcctacctggccggcgccgggctcgcgttcagcctgatgaagtccctgggcgggggccggcgcgggacgggcgcccagggcgagaccctcggggagaagtggaagcggcagctgaaccagctgtccaagagcgagttcaacacctacaagcgctccggcatcatggaggtggaccggagcgaggccaaggaggggctcaagcgcggcgagaccacgaagcacgccgtctcccgggggaccgcgaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacgtacggctggaacctggtcaagctgcactccgggaaggacgtgttcttcatcccgcccgagaagtgcgacaccctcctgtgcgacatcggcgagagctcccccaacccgaccatcgaggaggggcggaccctgcgcgtgctcaagatggtcgagccctggctgcggggcaaccagttctgcatcaagatcctgaacccctacatgcccagcgtggtggagaccctcgagcagatgcagcgcaagcacggcgggatgctggtccggaacccgctgtcccgcaacagcacgcacgagatgtactgggtgtcctgcggcaccgggaacatcgtgagcgccgtcaacatgacctcccgcatgctcctgaaccggttcaccatggcccaccgcaagcccacgtacgagcgggacgtggacctgggcgcgggcacccgccacgtggccgtcgagcccgaggtggccaacctcgacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgacgaagccctgggacgtgatccccatggtgacccagatcgcgatgaccgacaccacgcccttcgggcagcagcgcgtcttcaaggagaaggtggacacccggaccccgaaggccaagcgcggcaccgcccagatcatggaggtgacggccaagtggctctggggcttcctgtcccggaacaagaagccccgcatctgcacccgggaggagttcacccgcaaggtccggagcaacgccgcgatcggggccgtgttcgtggacgagaaccagtggaactccgccaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgcggacgacacggccgggtgggacacccgcatcaccgaggacgacctccagaacgaggcccgcatcaccgacatcatggagccggagcacgccctgctggccaagtccatcttcaagctcacgtaccagaacaaggtggtgcgggtccagcgccccgcgaagaacggcaccgtgatggacgtgatcagccggcgcgaccagcgggggtccggccaggtcggcacctacgggctgaacaccttcacgaacatggaggcccagctgatccgccagatggagagcgagggcatcttctcccccagcgagctcgagacccccaacctggccgagcgggtgctggactggctcgagaagtacggggtggagcgcctgaagcggatggccatctccggcgacgactgcgtcgtgaagccgatcgacgaccgcttcgccaccgcgctgaccgccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgccgggtggagcctccgcgagacggcctgcctgggcaagtcctacgcgcagatgtggcagctgatgtacttccaccggcgcgacctccggctggccgccaacgccatctgcagcgcggtgcccgtcgactggatccccacctcccgcaccacctggagcatccacgcccaccaccagtggatgacgaccgaggacatgctgtccgtgtggaaccgcgtgtggatcgaggagaacccctggatggaggacaagacccacatcagctcctggggcgacgtcccgtacctcggcaagcgggaggaccagtggtgcggcagcctgatcgggctgaccgcccgcgccacctgggccacgaacatccaggtggcgatcaaccaggtgcggcgcctcatcggcaacgagaactacctggactacatgacctccatgaagcggttcaagaacgagagcgaccccgagggggccctgtggtga

SEQ ID NO: 8712 - RNA, 9879 nt, synthetic construct
  misc_feature 1..9879: note = derived and/or modified CDS sequence (opt1) from DENV-1__JF937619__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgggagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggtgcaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcctggaacatctgggaggtggaggactacggcttcgggatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgaagtccatggtcagcgccggctccggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacctggaacgacctcatccgcctgtgcatcatggtgggcgccaacgcgtccgaccgcatggggatgggcacgacctacctggccctcatggtgaccttcaagatgcggccgatgttcgccgtcggcctgctgttccgccggctcaccagccgcgaggtgctgctgctcacgatcgggctgtccctggtcgccagcgtggagctccccaactccctggaggagctgggcgacgggctcgccatgggcatcatgatcctgaagctgctcaccgacttccagagctaccagctgtgggcgaccctgctctccctgaccttcatcaagacgaccttcagcctgcactacgcctggaagaccatggccatggtgctctccatcgtcagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgcgacgacaccctcaccatcctgctgaaggccaccctcctggcggtcagcggcgtgtacccgctgtccatccccgccaccctcttcgtgtggcacttctggcagaagaagaagcagcggagcggggtcctgtgggacacgcccagcccgcccgaggtggagcgcgccgtgctggacgacggcatctaccggatcatgcagcgcggcctgctcgggcggagccaggtcggcgtgggggtgttccaggagaacgtcttccacaccatgtggcacgtgacccgcggcgccgtgctgatgtaccaggggaagcggctggagccctcctgggccagcgtcaagaaggacctcatctcctacggcggcgggtggcgcttccagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgggaggggaagatcgtgggcctgtacggcaacggggtggtcacgaccagcggcacctacgtgtccgccatcgcgcaggccaaggccagccaggaggggccgctccccgagatcgaggacgaggtgttccgcaagcggaacctgaccatcatggacctgcaccccggctccgggaagacgcgccggtacctcccggccatcgtccgcgaggcgatcaagcggaagctgcgcaccctgatcctcgcccccacccgcgtggtggccagcgagatggccgaggccctgaagggcatgcccatccggtaccagaccacggcggtcaagtccgagcacaccggcaaggagatcgtggacctgatgtgccacgccaccttcaccatgcgcctcctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcatggaggccttcccgcagtccaacgcggtgatccaggacgaggagcgcgacatccccgagcggagctggaactccgggtacgagtggatcacggacttccccggcaagaccgtctggttcgtgcccagcatcaaggccggcaacgacatcgccaactgcctgcgcaagaacgggaagcgggtgatccagctctcccgcaagaccttcgacaccgagtaccagaagaagaagaacaacgactgggactacgtcgtgacgaccgacatcagcgagatgggcgccaacttccgggcggaccgcgtgatcgacccgcggcgctgcctgaagcccgtcatcctgaaggacgggcccgagcgggtgatcctcgccggccccatgccggtcaccgtggcctccgccgcccagcgccgggggcgcatcggccggaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgcgagaagtccgccgccatcgacggggagtaccgcctgcggggcgaggcgcgcaagaccttcgtggagctcatgcggcgcggggacctgcccgtctggctgtcctacaaggtggccagcgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacctactccgaccccctcgccctgcgcgagttcaaggagttcgccgcgggccggcgcagcgtgtccggggacctgatcctcgagatcggcaagctgccgcagcacctgacgcagcgggcccagaacgccctcgacaacctggtgatgctgcacaacagcgagcagggcgggcgcgcctaccggcacgcgatggaggagctccccgacaccatcgagaccctgatgctgctcgccctgatcgccgtcctgaccggcggggtgaccctgttcttcctgtccggcaaggggctgggcaagaccagcatcggcctcctgtgcgtgatggcctccagcgtcctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccacgaagaaggacctggggatcggccacgtcgcggtggagaaccaccaccacgccgccatgctcgacgtggacctgcaccccgcctccgcctggaccctgtacgcggtcgccaccaccatcatcacgccgatgatgcgccacaccatcgagaacaccaccgccaacatcagcctcacggccatcgccaaccaggcggccatcctgatggggctggacaagggctggcccatctccaagatggacatcggcgtgcccctcctggccctggggtgctacagccaggtgaaccccctcaccctgaccgccgcggtcctgatgctcgtggcccactacgccatcatcggcccggggctgcaggccaaggccacccgggaggcgcagaagcgcacggccgccggcatcatgaagaaccccaccatcgacgggatcgtggccatcgacctggaccccgtcatctacgacgccaagttcgagaagcagctcggccagatcatgctgctgatcctctgcacctcccagatcctgctgatgcgcaccacgtgggcgctctgcgagagcatcaccctggccaccggccccctgaccacgctctgggaggggtccccgggcaagttctggaacaccaccatcgccgtgagcatggccaacatcttccgggggtcctacctggccggcgcgggcctggccttcagcctcatgaagtccctcgggggcgggcgccgggggaccggggcccagggcgagacgctgggcgagaagtggaagcgccagctcaaccagctgtccaagagcgagttcaacacctacaagcggtccgggatcatggaggtggaccgcagcgaggccaaggagggcctgaagcgcggggagaccaccaagcacgcggtctcccgcggcacggccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggccacctacgggtggaacctcgtcaagctgcactccggcaaggacgtgttcttcatcccgcccgagaagtgcgacacgctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacgcacgagatgtactgggtgtcctgcgggaccggcaacatcgtgagcgccgtcaacatgacctcccgcatgctgctcaaccggttcaccatggcgcaccgcaagcccacctacgagcgcgacgtggacctgggggccggcacgcggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacgcagatcgccatgaccgacaccacccccttcggccagcagcgggtcttcaaggagaaggtggacacgcgcaccccgaaggccaagcgggggaccgcccagatcatggaggtgaccgcccgctggctgtggggcttcctctcccggaacaagaagccccgcatctgcacgcgggaggagttcacccgcaaggtccggagcaacgcggccatcggcgccgtgttcgtggacgagaaccagtggaactccgccaaggaggcggtcgaggacgaccgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacgcgcatcaccgaggacgacctgcagaacgaggccaagatcaccgacatcatggagccggagcacgccctcctggcgaagtccatcttcaagctgacctaccagaacaaggtggtgcgggtccagcgccccgccaagaacgggacggtgatggacgtgatcagccgccgggaccagcgcggctccgggcaggtcggcacctacggcctcaacaccttcaccaacatggaggcccagctgatccggcagatggagagcgaggggatcttcctgcccaacgagctcgagacgcccaacctggccggccgcgtgctggactggctcgagaagtacggggtggagcggctgaagcgcatggccatctccggcgacgactgcgtcgtgaagccgatcgacgaccggttcgcgaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggtccctccgggagaccgcgtgcctgggcaagagctacgcccagatgtggcagctgatgtacttccaccgccgggacctccgcctggccgccaacgcgatctgcagcgccgtgcccgtcgactgggtgcccacgtcccggaccacctggagcatccacgcccaccaccagtggatgaccacggaggacatgctgtccgtgtggaaccgcgtctggatcgaggagaacccctggatggaggacaagacccggatcagctcctgggaggacgtgccgtacctcgggaagcgcgaggaccagtggtgcggcagcctgatcggcctgaccgcccgcgccacctgggcgacgaacatccaggtggccatcaaccaggtccggcgcctcatcgggaacgagaactactccgactacatgaccagcatgaagcggttcaagaacgagtccgagcccgagggcgccctgtggtga

SEQ ID NO: 8713 - RNA, 9879 nt, synthetic construct
  misc_feature 1..9879: note = derived and/or modified CDS sequence (opt1) from DENV-1__GU131827__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttccgcaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgccatcaactggaagggccgcgagctcaagtgcgggagcggcatcttcgtcaccaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgcgggcatcctcgcccaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcgtggaacatctgggaggtggaggactacggcttcgggatcttcacgaccaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacgtgcatctggcccaagtcccacaccctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtggtcgacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcacgctggccgtgttcttcctgctcatcatggggcagctgacctggaacgacctgatccgcctctgcatcatggtgggcgcgaacgccagcgaccggatggggatgggcaccacctacctggccctgatggccacgttcaagatgcgcccgatgttcgccgtcggcctcctgttccggcgcctgacctcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctccccgtgctgctgggcagcctcgggtgcaagccgctgaccatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccacgctgctcgccgtctccggcgtgtacccgctgagcatccccgccaccctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacgcgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctccccgagatcgaggacgaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtggtggcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgcgaacttccgggccgaccgcgtcatcgacccgcggcgctgcctgaagcccgtgatcctgaaggacgggcccgagcgggtgatcctcgccggccccatgccggtcaccgtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcgtccccgccctgttcgagccggagcgggagaagtccgccgcgatcgacggggagtaccgcctgcggggcgaggcccgcaagacgttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacacgatcgagaccctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgaccgtggccgcgaacgagatgggcctcctggagaccaccaagaaggacctggggatcggccacgtggccgtcgagaaccaccaccacgccgccatgctcgacgtggacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtccccctcctggccctggggtgctacagccaggtgaaccccctcacgctgaccgcggccgtgctgatgctcgtcgcccactacgccatcatcggcccggggctgcaggccaaggcgacccgggaggcccagaagcgcaccgccgccggcatcatgaagaaccccacggtggacgggatcgtggccatcgacctggaccccgtcgtgtacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtcgaccggagcgaggcgaaggagggcctgaagcgcggggagaccaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacgtcccgcatgctgctcaaccggttcaccatggcccaccgcaagcccacctacgagcgggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcgtaccacgggtcctacgaggtcaagccgagcggctccgccagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgcgaagtggctgtggggcttcctctcccggaacaagaagccccgcatctgcacccgggaggagttcacgcgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgcgctcctggccaagtccatcttcaagctgacctaccagaacaaggtggtccgggtgcagcgccccgccaagaacgggaccgtgatggacgtcatcagccggcgcgaccagcggggctccggccaggtgggcacgtacggcctcaacaccttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctggggaagcgggaggaccagtggtgcggcagcctcatcggcctgaccgcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8714 - RNA, 9879 nt, synthetic construct
  misc_feature 1..9879: note = derived and/or modified CDS sequence (opt1) from DENV-1__GU131831__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatcagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatgatcctcagcatcgtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtggagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8715 - RNA, 9879 nt, synthetic construct
  misc_feature 1..9879: note = derived and/or modified CDS sequence (opt1) from DENV-1__EU482789__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagatggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctgaccgactacggggccctcaccctggactgcagcccccgcacgggcctggacttcaacgagatggtgctcctgaccatgaaggagaagtcctggctggtccacaagcagtggttcctcgacctgccgctgccctggaccagcggggccagcacctcccaggagacgtggaaccggcaggacctcctggtgaccttcaagaccgcccacgcgaagaagcaggaggtggtcgtgctgggcagccaggagggcgccatgcacaccgccctcacgggggccaccgagatccagacctccggcaccacgaccatcttcgccgggcacctgaagtgccgcctgaagatggacaagctcaccctgaagggcatgagctacgtgatgtgcaccgggtccttcaagctggagaaggaggtcgcggagacgcagcacggcaccgtgctcgtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctgagctggttcaagaaggggtccagcatcggcaagatgttcgaggccaccgcccgcggggcccggcgcatggcgatcctcggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctcctgacgtggctgggcctcaactcccgcagcacctccctgagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgtgggcatcctggcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctggggctcctgtgcatctccatcatgatcgaggaggtgatgcgcagccggtggtcccgcaagatgctgatgaccggcaccctcgccgtgttcctgctgctcatcatggggcagctgacgtggaacgacctgatccggctctgcatcatggtcggcgccaacgcgagcgaccgcatggggatgggcaccacctacctggccctgatggccaccttcaagatgcgcccgatgttcgccgtggggctcctgttccggcgcctgacgtcccgggaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtcctcagcatcgtgtccctgttccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtcggcgtggtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgaccctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacccggggcgccgtgctgatgtaccaggggaagcgcctggagcccagctgggcgtccgtgaagaaggacctcatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgcgaggggaagatcgtcggcctctacggcaacggggtggtgaccaccagcggcacctacgtcagcgcgatcgcccaggccaaggcctcccaggaggggccgctgcccgagatcgaggacgaggtgttccggaagcgcaacctgacgatcatggacctccaccccggcagcgggaagacccggcgctacctgccggcgatcgtgcgggaggccatcaagcgcaagctgcggaccctcatcctggcccccacccgcgtcgtggcctccgagatggccgaggcgctgaagggcatgcccatccgctaccagacgaccgccgtcaagagcgagcacaccggcaaggagatcgtcgacctcatgtgccacgccaccttcacgatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctgaagcccgtcatcctcaaggacgggcccgagcgcgtgatcctggccggccccatgccggtcacggtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggacgaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccaccatgctggacgtggacctgcaccccgcctccgcctggacgctctacgccgtcgcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtgaaccccctgacgctgaccgccgccgtcctcatgctggtggcgcactacgccatcatcggcccggggctgcaggccaaggccacccgggaggcccagaagcgcaccgcggccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtcagcatggccaacatcttccgggggtcctacctggccggcgccggcctcgcgttcagcctgatgaagtccctggggcgcggccggcgcgggaccggcgcccagggggagaccctcggcgagaagtggaagcggcagctgaaccagctgtccaagagcgagttcaacatctacaagcgctccggcatcatggaggtggaccggagcgaggccaaggaggggctcaagcgcggcgagacgacccggcacgccgtgtcccgcgggaccgcgaagctgcggtggttcgtcgagcgcaacctggtgaagcccgagggcaaggtgatcgacctggggtgcggccggggcgggtggagctactactgcgccggcctcaagaaggtcaccgaggtgaaggggtacacgaagggcgggcccggccacgaggagcccatcccgatggccacctacggctggaacctggtgaagctgcactccgggaaggacgtcttcttcacgccgcccgagaagtgcgacaccctcctgtgcgacatcggcgagagctcccccaacccgacgatcgaggaggggcgcaccctgcgggtgctcaagatggtggagccctggctgcgcggcaaccagttctgcatcaagatcctgaacccctacatgcccagcgtcgtggagaccctcgagcagatgcagcggaagcacgggggcatgctggtgcgcaacccgctgtcccggaacagcacccacgagatgtactgggtctcctgcggcaccgggaacatcgtgagcgccgtgaacatgacgtcccgcatgctcctgaaccgcttcaccatggcccaccggaagcccacctacgagcgcgacgtcgacctgggcgcggggacccggcacgtggccgtggagcccgaggtcgccaacctcgacatcatcggccagcgcatcgagaacatcaagcacgagcacaagagcacgtggcactacgacgaggacaacccctacaagacctgggcctaccacggctcctacgaggtgaagccgagcgggtccgccagcagcatggtcaacggcgtggtgaagctgctgaccaagccctgggacgtcatccccatggtgacccagatcgcgatgacggacaccacccccttcgggcagcagcgggtgttcaaggagaaggtcgacacccgcacgccgaaggccaagcggggcaccgcccagatcatggaggtgaccgcccgctggctctgggggttcctgtcccggaacaagaagccccgcatctgcacccgggaggagttcacgcgcaaggtgcggagcaacgccgcgatcggcgccgtcttcgtggacgagaaccagtggaactccgccaaggaggccgtggaggacgagcgcttctgggacctggtccagaaggagcgggagctccacaagcagggcaagtgcgcgacctgcgtgtacaacatgatggggaagcgcgagaagaagctgggcgagttcgggaaggccaagggcagccgggccatctggtacatgtggctgggggcccgcttcctcgagttcgaggccctgggcttcatgaacgaggaccactggttctcccgggagaacagcctgtccggcgtggagggggagggcctccacaagctggggtacatcctgcgcgacatcagcaagatccccggcgggaacatgtacgcggacgacaccgccggctgggacacccggatcacggaggacgacctccagaacgaggccaagatcaccgacatcatggagccggagcacgccctgctggccacctccatcttcaagctcacctaccagaacaaggtcgtgcgcgtgcagcgccccgccaagagcggcacggtcatggacgtgatctcccggcgcgaccagcgggggagcggccaggtggggacctacggcctgaacaccttcaccaacatggaggcgcagctgatccgccagatggagtccgagggcatcttcctccccagcgagctggagacgcccaacctggccgagcgggtcctcgactggctggagaagtacggggtggagcgcctgaagcggatggccatctccggcgacgactgcgtggtcaagccgatcgacgaccgcttcgccaccgcgctcaccgccctgaacgacatggggaaggtgcggaaggacatcccccagtgggagcccagcaagggctggaacgactggcagcaggtccccttctgctcccaccacttccaccagctgatcatgaaggacgggcgcgagatcgtcgtgccgtgccggaaccaggacgagctcgtgggccgcgcccgggtcagccagggcgccgggtggagcctgcgcgagaccgcctgcctgggcaagtcctacgcgcagatgtggcagctcatgtacttccaccggcgcgacctgcggctggccgccaacgccatctgcagcgcggtgcccgtggactgggtccccacgtcccgcaccacctggagcatccacgcccaccaccagtggatgaccacggaggacatgctctccgtgtggaaccgggtgtggatcgaggagaacccctggatggaggacaagacccacgtcagctcctggggcgacgtgccgtacctgggcaagcgcgaggaccagtggtgcgggagcctgatcggcctcaccgcccgcgccacctgggcctccaacatccaggtggcgatcaaccaggtccggcgcctgatcggcaacgagaactacctggactacatgaccagcatgaagcggttcaagaacgagggggaccccgagggcgccctctggtga

SEQ ID NO: 8716 - RNA, 9879 nt, synthetic construct
  misc_feature 1..9879: note = derived and/or modified CDS sequence (opt1) from DENV-1__EU482790__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagacctccgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcgggtccagcacctcccaggagacctggaaccggcaggacctcctggtgacgttcaagaccgcccacgccaagaagcaggaggtcgtggtgctgggcagccaggagggcgcgatgcacaccgccctcaccggggccacggagatccagacctccggcaccaccacgatcttcgccgggcacctgaagtgccgcctgaagatggacaagctcaccctgaagggcatgagctacgtcatgtgcaccgggtccttcaagctggagaaggaggtggccgagacccagcacggcacggtgctcgtccagatcaagtacgagggcaccgacgtgccctgcaagatccccttcagcacccaggacgagaagggggtgacccagaacggccggctgatcacggcgaacccgatcgtcaccgacaaggagaagcccgtgaacatcgaggccgagccgcccttcggggagtcctacatcgtgatcggcgccggcgagaaggccctgaagctgagctggttcaagaaggggtccagcatcggcaagatgttcgaggcgaccgcccgcggggcccggcgcatggccatcctcggcgacaccgcctgggacttcgggtccatcggcggcgtcttcacgagcgtggggaagctggtgcaccagatcttcggcaccgcgtacggggtcctgttctccggcgtgagctggaccatgaagatcgggatcggcgtgctcctgacctggctgggcctcaactcccgcagcacgtccctgagcatgacctgcatcgccgtcgggctggtgaccctctacctgggcgtgatggtccaggccgacagcgggtgcgtgatcaactggaagggccgggagctgaagtgcgggtccggcatcttcgtgaccaacgaggtccacacgtggaccgagcagtacaagttccaggccgacagcccgaagcgcctctccgccgcgatcggcaaggcctgggaggagggggtgtgcggcatccggagcgccacccgcctggagaacatcatgtggaagcagatctccaacgagctgaaccacatcctcctggagaacgacatgaagctgaccgtggtcgtgggggacgtggccggcatcctcgcccaggggaagaagatgatccggccccagcccatggagtacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacccaggtgtgcgaccaccgcctcatgtccgccgcgatcaaggacagcaaggccgtccacgccgacatgggctactggatcgagtccgagaagaacgagacctggaagctggcccgggccagcttcatcgaggtgaagacctgcatctggcccaagtcccacaccctgtggagcaacggcgtgctcgagtccgagatgatcatccccaagatctacgggggcccgatcagccagcacaactaccgccccgggtacttcacgcagaccgcgggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtcaagagcatggtctccgccggcagcggcgaggtggactccttcagcctcgggctgctgtgcatctccatcatgatcgaggaggtgatgcgcagccggtggtcccgcaagatgctcatgaccggcaccctggccgtcttcttcctgctcatcatggggcagctgacctggaacgacctgatccggctctgcatcatggtgggcgccaacgccagcgaccgcatggggatgggcacgacctacctggcgctgatggccaccttcaagatgcgcccgatgttcgccgtgggcctcctgttccggcgcctgacctcccgggaggtcctcctgctgacgatcgggctcagcctggtggcctccgtcgagctgcccaacagcctcgaggagctgggcgacgggctggccatgggcatcatgatcctcaagctgctgaccgacttccagtcccaccagctctgggcgaccctgctgagcctcaccttcatcaagacgaccttctccctgcactacgcctggaagaccatggccatggtgctgagcatcgtgtccctcttccccctgtgcctgagcaccacgtcccagaagaccacctggctccccgtcctgctgggcagcctcgggtgcaagccgctgaccatgttcctgatcgccgagaacaagatctggggccgcaagagctggcccctcaacgaggggatcatggcggtgggcatcgtgtccatcctgctgagctccctcctgaagaacgacgtccccctggccgggcccctcatcgccggcggcatgctgatcgcctgctacgtgatcagcgggtccagcgccgacctgtccctcgagaaggcggccgaggtgagctgggaggaggaggccgagcactccggcgccagccacaacatcctggtcgaggtgcaggacgacgggacgatgaagatcaaggacgaggagcgggacgacaccctgaccatcctcctgaaggccaccctgctcgcggtgtccggcgtctacccgctgagcatccccgccaccctgttcgtgtggtacttctggcagaagaagaagcagcgctccggggtgctctgggacacgcccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacccggggcgccgtgctcatgtaccaggggaagcgcctggagcccagctgggcctccgtgaagaaggacctgatcagctacggcggcgggtggcggctccagggctcctggaacaccggggaggaggtccaggtgatcgcggtggagcccggcaagaaccccaagaacgtccagacggcccccgggaccttcaagaccagcgagggcgaggtgggcgccatcgccctggacttcaagcccgggaccagcggctcccccatcgtgaaccgcgaggggaagatcgtcggcctgtacggcaacggggtggtgacgaccagcggcacctacgtctccgccatcgcgcaggccaaggccagccaggaggggcccctcccggagatcgaggacgaggtgttccggaagcgcaacctgaccatcatggacctgcaccccggctccgggaagacgcggcgctacctccccgccatcgtgcgggaggcgatcaagcgcaagctgcggaccctgatcctcgccccgacccgcgtcgtggccagcgagatggccgaggccctgaagggcatgcccatccgctaccagaccacggcggtgaagtccgagcacaccggcaaggagatcgtcgacctgatgtgccacgccaccttcaccatgcggctcctgagccccgtgcgcgtgcccaactacaacatgatcatcatggacgaggcccacttcacggacccgtccagcatcgccgcccgggggtacatctccacccgcgtcggcatgggggaggcggccgccatcttcatgaccgccacgccgcccggcagcgtggaggccttcccccagtccaacgcggtgatccaggacgaggagcgggacatcccggagcgcagctggaactccgggtacgagtggatcacggacttccccggcaagaccgtctggttcgtgcccagcatcaagtccggcaacgacatcgccaactgcctgcggaagaacgggaagcgcgtgatccagctcagccggaagaccttcgacaccgagtaccagaagacgaagaacaacgactgggactacgtcgtgaccaccgacatctccgagatgggcgccaacttccgcgccgaccgggtgatcgacccccgccggtgcctgaagccggtcatcctgaaggacgggcccgagcgcgtgatcctcgcgggccccatgcccgtcaccgtggccagcgccgcccagcggcgcgggcggatcggccgcaaccacaacaaggagggcgaccagtacatctacatggggcagccgctgaacaacgacgaggaccacgcccactggacggaggcgaagatgctgctcgacaacatcaacacccccgagggcatcatccccgccctgttcgagcccgagcgggagaagtccgccgccatcgacggggagtaccgcctgcgcggcgaggcccggaagaccttcgtggagctcatgcgccgcggggacctgccggtctggctgtcctacaaggtggcgagcgagggcttccagtactccgaccgccggtggtgcttcgacggcgagcgcaacaaccaggtgctcgaggagaacatggacgtcgagatctggaccaaggagggggagcggaagaagctgcgcccccggtggctggacgcccgcacgtacagcgaccccctcgccctgcgggagttcaaggagttcgccgccggccgccggtccgtgagcggggacctgatcctcgagatcggcaagctgccccagcacctgacccagcgcgcgcagaacgccctcgacaacctggtgatgctgcacaactccgagcagggcgggcgggcctaccgccacgccatggaggagctcccggacaccatcgagaccctgatgctgctcgcgctgatcgccgtcctgacgggcggggtgaccctcttcttcctgagcggccgggggctgggcaagacctccatcggcctcctgtgcgtgatggccagctccgtcctgctctggatggccagcgtggagccccactggatcgccgcgtccatcatcctggagttcttcctgatggtgctcctgatccccgagcccgaccgccagcggaccccgcaggacaaccagctggcctacgtcgtgatcgggctcctgttcatgatcctgaccgtggccgccaacgagatgggcctcctggagacgaccaagaaggacctggggatcggccacgtcgccgtggagaaccaccaccacgcggccatgctcgacgtggacctgcaccccgccagcgcctggaccctgtacgccgtcgcgaccacgatcatcacccccatgatgcgccacaccatcgagaacaccacggccaacatctccctcaccgccatcgccaaccaggccgcgatcctgatggggctggacaagggctggccgatcagcaagatggacatcggcgtgcccctcctggccctggggtgctactcccaggtgaaccccctcaccctgaccgccgccgtcctgatgctcgtggcgcactacgccatcatcggccccgggctgcaggccaaggccacgcgggaggcccagaagcgcaccgcggccggcatcatgaagaacccgaccgtggacgggatcgtcgccatcgacctggaccccgtggtgtacgacgccaagttcgagaagcagctcggccagatcatgctgctgatcctctgcaccagccagatcctgctgatgcgcacgacctgggccctctgcgagtccatcaccctggcgaccggccccctgacgaccctctgggaggggagccccggcaagttctggaacaccaccatcgccgtcagcatggccaacatcttccgggggtcctacctggccggcgccggcctggcgttcagcctcatgaagtccctcgggggcgggcgccgggggacgggggcccagggcgagaccctgggcgagaagtggaagcgccagctcaaccagctgagcaagtccgagttcaacacctacaagcggagcgggatcatggaggtggaccgctccgaggccaaggagggcctgaagcgcggggagaccacgaagcacgccgtgagccgcggcaccgcgaagctccggtggttcgtcgagcgcaacctggtgaagccggaggggaaggtgatcgacctgggctgcggccgcggcgggtggtcctactactgcgccgggctgaagaaggtcaccgaggtgaaggggtacaccaagggcgggcccggccacgaggagcccatccccatggccacgtacgggtggaacctcgtgaagctgtacagcggcaaggacgtcttcttcatcccgcccgagaagtgcgacaccctgctctgcgacatcggggagtccagccccaaccccaccatcgaggagggccgcaccctgcgggtgctgaagatggtggagccgtggctccgcgggaaccagttctgcatcaagatcctgaacccctacatgccctccgtcgtggagacgctggagcagatgcagcggaagcacggcggcatgctcgtgcgcaaccccctgagccggaactccacccacgagatgtactgggtcagctgcgggaccggcaacatcgtgtccgccgtgaacatgaccagccgcatgctgctcaaccggttcaccatggcccaccgcaagccgacgtacgagcgcgacgtcgacctgggggcgggcacccggcacgtggccgtggagcccgaggtccccaacctggacatcatcggccagcgcatcgagaacatcaagcacgagcacaagtccacctggcactacgacgaggacaacccctacaagacctgggcctaccacgggagctacgaggtgaagccgagcggctccgccagctccatggtcaacggggtggtgaagctcctgacgaagccctgggacgtcatccccatggtgacccagatcgccatgaccgacaccacgcccttcggccagcagcgggtgttcaaggagaaggtcgacacccgcaccccgaaggcgaagcgggggaccgcccagatcatggaggtgacggccaagtggctgtggggcttcctcagccgcaacaagaagccccggatctgcacccgcgaggagttcacccggaaggtgcgctccaacgccgccatcggcgcggtcttcgtggacgagaaccagtggaacagcgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggcgaaggggtcccgggccatctggtacatgtggctgggcgcccgcttcctggagttcgaggccctcggcttcatgaacgaggaccactggttcagccgggagaactccctgagcggggtggagggcgaggggctgcacaagctcggctacatcctgcgcgacatctccaagatccccgggggcaacatgtacgccgacgacacggcgggctgggacacccggatcaccgaggacgacctgcagaacgaggccaagatcaccgacatcatggagccggagcacgccctcctggccaagagcatcttcaagctgacgtaccagaacaaggtcgtgcgcgtgcagcggcccgccaagaacgggaccgtcatggacgtgatctcccgccgcgaccagcggggcagcggccaggtgggcacctacggcctcaacaccttcacgaacatggaggcgcagctgatccgccagatggagtccgaggggatcttcagcccctccgagctggagacccccaacctcgccggccgggtcctggactggctggagaagcacggggtggagcgcctcaagcggatggccatcagcggcgacgactgcgtggtcaagccgatcgacgaccgcttcgccaccgccctgaccgcgctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggtccctgcgcgagacggcctgcctcggcaagagctacgcccagatgtggcagctgatgtacttccaccggcgcgacctgcggctcgcggccaacgccatctgctccgccgtgcccgtggactgggtccccaccagccgcaccacctggtccatccacgcgcaccaccagtggatgacgaccgaggacatgctgagcgtgtggaaccgggtgtggatcgaggagaacccctggatggaggacaagacccacatctccagctggggcgacgtcccgtacctgggcaagcgcgaggaccagtggtgcggctccctcatcgggctgaccgcccgggccacgtgggccaccaacatccaggtggccatcaaccaggtgcgccgcctgatcggcaacgagaactacctcgactacatgaccagcatgaagcggttcaagaacgagtccgaccccgagggggcgctgtggtga

SEQ ID NO: 8717 - RNA, 9879 nt, synthetic construct
  misc_feature 1..9879: note = derived and/or modified CDS sequence (opt1) from DENV-1__EU482791__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatgatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgggaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcacggggaacatcgtgagcgccgtgaacatgacctcccggatgctgctgaaccgcttcaccatggcccaccgcaagcccacctacgagcgggacgtcgacctcggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtcctggactggctggagaagtacggggtggagcggctcaagcgcatggccatcagcggcgacgactgcgtggtcaagccgatcgacgaccggttcgccaccgcgctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgcggtgcccgtggactgggtccccaccagccggaccacctggtccatccacgcccaccaccagtggatgacgaccgaggacatgctgagcgtgtggaaccgcgtgtggatcgaggagaacccctggatggaggacaagacccacgtctccagctggggcgacgtgccgtacctgggcaagcgggaggaccagtggtgcggctccctcatcgggctgaccgcccgcgccacctgggccagcaacatccaggtggcgatcaaccaggtccgccggctgatcggcaacgagaactacctcgactacatgacgtccatgaagcgcttcaagaacgagggggaccccgagggcgccctgtggtga

SEQ ID NO: 8718 - RNA, 9879 nt, synthetic construct
  misc_feature 1..9879: note = derived and/or modified CDS sequence (opt1) from DENV-1__EU482792__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggggagctgtgcgaggacaccatgacctacaagtgcccccggatcaccgagaccgagcccgacgacgtggactgctggtgcaacgccaccgacacctgggtgacctacgggacctgcagccagaccggggagcaccggcgcgacaagcggagcgtggccctcgcgccccacgtgggcctggggctggagacccgcaccgagacgtggatgtccagcgagggcgcctggaagcagatccagcgggtggagacctgggccctccgccaccccgggttcaccgtgatcgccctgttcctggcccacgcgatcggcacctccatcacgcagaaggggatcatcttcatcctcctgatgctggtgacccccagcatggccatgcggtgcgtcggcatcggctcccgcgacttcgtggaggggctcagcggcgccacctgggtggacgtcgtgctggagcacgggtcctgcgtgaccacgatggccaaggacaagcccaccctggacatcgagctcctgaagaccgaggtcaccaaccccgccgtgctgcggaagctctgcatcgaggcgaagatcagcaacacgaccaccgactcccgctgccccacccagggcgaggccacgctgatggaggagcaggacgccaacttcgtgtgccggcgcaccttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgacggtgcacaccggcgaccagcaccaggtcgggaacgagagcaccgagcacggcaccaccgccacgatcacgccccaggcgcccacctccgagatccagctcaccgactacggggccctgacgctggactgcagcccccgcaccggcctcgacttcaacgagatggtgctgctgaccatgaaggagaagtcctggctcgtccacaagcagtggttcctggacctgccgctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgtgggcatcctcgcccaggggaagaagatgatccggccccagcccatggagcacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgcgggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcctgctcctgatcatggggcagctgacctggaacgacctcatccggctgtgcatcatggtcggcgccaacgccagcgaccgcatggggatgggcaccacctacctggcgctcatggccacgttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctgggcagcctggggtgcaagccgctcaccatgttcctgatcgccgagaacaagatctggggccgcaagtcctggcccctgaacgaggggatcatggcggtcggcgtggtgagcatcctcctgagctccctgctcaagaacgacgtccccctggccgggcccctgatcgccggcggcatgctcatcgcctgctacgtgatcagcgggtccagcgccgacctgtccctggagaaggcggccgaggtgagctgggaggaggaggccgagcactccggcgccagccacaacatcctcgtcgaggtgcaggacgacgggaccatgaagatcaaggacgaggagcgggacgacaccctgaccatcctgctcaaggccacgctgctggcggtgtccggcgtctacccgctcagcatccccgccaccctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacgcggggcgccgtgctgatgtaccaggggaagcgcctcgagcccagctgggcctccgtgaagaaggacctgatcagctacggcggcgggtggcggctgcagggctcctggaacaccggggaggaggtccaggtgatcgcggtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtgcgggaggcgatcaagcgcaagctccggaccctgatcctggcccccacgcgcgtcgtggcctccgagatggccgaggccctcaagggcatgcccatccgctaccagaccaccgcggtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcccgggggtacatcagcacccgcgtcggcatgggggaggcggccgccatcttcatgacggccacgccgcccggctccgtggaggccttcccgcagagcaacgcggtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgccgaccgggtgatcgacccgcgccggtgcctcaagcccgtcatcctgaaggacgggcccgagcgcgtgatcctggcgggccccatgccggtcaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtggagctgatgcgccgcggggacctccccgtctggctgtcctacaaggtggcgagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgccggccgccggagcgtgtccggggacctgatcctggagatcggcaagctcccgcagcacctgacccagcgcgcgcagaacgccctggacaacctcgtgatgctgcacaacagcgagcagggcgggcgggcctaccgccacgccatggaggagctgcccgacacgatcgagaccctcatgctgctggcgctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgccgcgagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgccgtggagaaccaccaccacgcgacgatgctggacgtggacctccaccccgcctccgcctggaccctgtacgccgtcgccaccaccatcatcacgccgatgatgcgccacaccatcgagaacaccaccgcgaacatcagcctgacggccatcgccaaccaggccgccatcctcatggggctggacaagggctggcccatctccaagatggacatcggcgtgcccctgctcgcgctggggtgctacagccaggtgaaccccctgaccctcaccgccgccgtcctgatgctggtggcccactacgcgatcatcggcccggggctccaggccaaggccacccgggaggcccagaagcgcacggccgcgggcatcatgaagaaccccaccgtggacgggatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgccaccggccccctgaccacgctgtgggaggggtccccgggcaagttctggaacaccaccatcgcggtcagcatggccaacatcttccgggggtcctacctcgccggcgccggcctggccttcagcctgatgaagtccctcgggggcgggcgccggggcaccggggcgcagggcgagacgctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtgtcccggggcaccgccaagctgcgctggttcgtcgagcggaacctggtgaagcccgaggggaaggtgatcgacctcggctgcggccgcgggggctggagctactactgcgcggggctgaagaaggtcacggaggtgaagggctacaccaagggcgggcccggccacgaggagcccatcccgatggccacctacgggtggaacctggtgaagctccactccggcaaggacgtcttcttcacgccgcccgagaagtgcgacacgctgctgtgcgacatcggggagagctcccccaacccgaccatcgaggagggccggaccctccgcgtgctgaagatggtggagccctggctgcgggggaaccagttctgcatcaagatcctcaacccctacatgcccagcgtcgtggagaccctggagcagatgcagcgcaagtacggcggcatgctggtgcggaacccgctctcccgcaacagcacccacgagatgtactgggtctcctgcgggacgggcaacatcgtgagcgccgtgaacatgacctcccggatgctgctgaaccgcttcaccatggcccaccgcaagcccacctacgagcgggacgtcgacctcggggccggcacgcgccacgtggcggtggagcccgaggtcgccaacctggacatcatcggccagcggatcgagaacatcaagcacgagcacaagagcacctggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctgtggggcttcctgtcccgcaacaagaagccccggatctgcacgcgcgaggagttcacccggaaggtgcgcagcaacgccgccatcggcgcggtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggcgaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgccgacgacaccgcgggctgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgccaagaacgggaccgtcatggacgtgatcagccgccgggaccagcgcggctccggccaggtgggcacctacggcctgaacaccttcacgaacatggaggcgcagctcatccggcagatggagagcgaggggatcttcctgccctccgagctggagacccccaacctcgccgagcgcgtcctggactggctggagaagtacggcgtggagcggctcaagcgcatggccatcagcggggacgactgcgtggtcaagccgatcgacgaccggttcgccaccgccctgaccgcgctgaacgacatgggcaaggtgcgcaaggacatcccccagtgggagccctccaaggggtggaacgactggcagcaggtccccttctgcagccaccacttccaccagctcatcatgaaggacggccgggagatcgtcgtgccgtgccgcaaccaggacgagctggtgggccgggcccgcgtctcccagggggccggctggagcctgcgggagacggcctgcctcggcaagagctacgcccagatgtggcagctgatgtacttccaccgccgggacctgcgcctcgcggccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacgtctccagctggggcgacgtgccgtacctggggaagcgggaggaccagtggtgcggctccctcatcggcctgaccgcccgcgccacctgggccagcaacatccaggtggccatcaaccaggtccgccggctgatcgggaacgagaactacctcgactacatgacgtccatgaagcgcttcaagaacgagggcgaccccgagggggcgctgtggtga

SEQ ID NO: 8719 - RNA, 9879 nt, synthetic construct
  misc_feature 1..9879: note = derived and/or modified CDS sequence (opt1) from DENV-1__EU482707__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagctcaccgtggtggtcggggacgtggcgggcatcctggggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcaccacggtggtggtcgacgagcactgcgggaaccggggcccgtccctccgcaccaccaccgtgacggggaagatcatccacgagtggtgctgccggagctgcaccctgccgcccctgcgcttccggggcgaggacgggtgctggtacggcatggagatccgccccgtgaaggagaaggaggagaacctcgtcaagtccatggtgagcgccggcagcggggaggtggactccttcagcctgggcctgctctgcatctccatcatgatcgaggaggtcatgcggagccgctggtcccggaagatgctgatgaccgggaccctggccgtgttcttcctcctgatcatgggccagctgacgtggaacgacctcatccgcctgtgcatcatggtgggggcgaacgccagcgaccgcatgggcatgggcaccacctacctggccctcatggccaccttcaagatgcggccgatgttcgccgtcgggctgctgttccgccggctcacgtcccgcgaggtgctgctgctcaccatcggcctgagcctggtggcgtccgtcgagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcgggagcctgggctgcaagccgctgacgatgttcctcatcgccgagaacaagatctgggggcggaagtcctggcccctgaacgagggcatcatggccgtggggatcgtcagcatcctgctcagctccctgctgaagaacgacgtgcccctcgccggccccctgatcgccggcgggatgctgatcgcgtgctacgtgatcagcggctccagcgccgacctctccctggagaaggccgccgaggtcagctgggaggaggaggccgagcactccggggcgagccacaacatcctggtggaggtgcaggacgacggcaccatgaagatcaaggacgaggagcgcgacgacaccctcaccatcctgctgaaggccaccctcctggccgtctccggggtgtacccgctgagcatccccgccaccctcttcgtgtggtacttctggcagaagaagaagcagcggtccggcgtcctgtgggacacccccagcccgcccgaggtggagcgcgccgtgctggacgacggcatctaccggatcatgcagcgcgggctgctcggccggtcccaggtcggggtgggcgtgttccaggagaacgtcttccacaccatgtggcacgtgacccgcggggcggtgctgatgtaccagggcaagcggctggagcccagctgggcctccgtcaagaaggacctcatcagctacggcgggggctggcgcctgcgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctctacgggaacggcgtggtcaccaccagcgggacctacgtgagcgccatcgcccaggccaaggcgtcccaggagggcccgctgcccgagatcgaggacgaggtgttccggaagcgcaacctgacgatcatggacctccaccccgggagcggcaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccgggaaggagatcgtggacctcatgtgccacgccaccttcacgatgcggctgctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctccggaagaacggcaagcgcgtcatccagctgtcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctcaaggacggccccgagcgcgtgatcctggccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgccgcggtcgacggcgagtaccggctccgcggggaggcccggaagaccttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggacgaaggagggcgagcggaagaagctgcgcccccggtggctcgacgcccgcacctactccgaccccctggccctgcgggagttcaaggagttcgcggccgggcgccggagcgtctccggcgacctcatcctggagatcggcaagctgccgcagcacctcacccagcgcgcccagaacgccctggacaacctggtgatgctccacaacagcgagcagggcgggcgggcgtaccgccacgccatggaggagctgcccgacaccatcgagacgctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcggcctgctgttcatgatcctcacggtggccgcgaacgagatggggctgctggagaccaccaagaaggacctcggcatcgggcacgtggccgtcgagaaccaccaccacgccgccatgctggacgtggacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtccccctgctggccctcggctgctacagccaggtgaaccccctgaccctgacggcggccgtgctcatgctggtcgcccactacgccatcatcgggccgggcctgcaggccaaggcgacccgcgaggcccagaagcggaccgccgccgggatcatgaagaaccccaccgtggacggcatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtcgaccgcagcgaggcgaaggaggggctcaagcggggcgagacgaccaagcacgccgtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacacgaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgaccatcgaggaggggcgcacgctgcgggtcctcaagatggtggagccctggctgcgcggcaaccagttctgcatcaagatcctgaacccctacatgcccagcgtggtcgaggcgctcgagcagatgcagcggaagcacggcgggatgctggtgcgcaacccgctgtcccggaacagcacccacgagatgtactgggtgtcctgcggcaccgggaacatcgtcagcgccgtgaacatgacctcccgcatgctcctgaaccgcttcaccatggcccaccggaagcccacgtacgagcgcgacgtggacctgggcaccggcacccggcacgtcgccgtggagcccgaggtggccaacctcgacatcatcgggcagcgcatcgagaacatcaagcacgagcacaagagcacctggcactacgacgaggacaacccctacaagacgtgggcgtaccacggctcctacgaggtcaagccgagcgggtccgccagcagcatggtgaacggcgtcgtgaagctgctgaccaagccctgggacgtgatccccatggtcacccagatcgccatgaccgacacgacccccttcgggcagcagcgggtgttcaaggagaaggtggacacccgcaccccgaaggccaagcggggcacggcccagatcatggaggtcaccgcgcgctggctctggggcttcctgtcccggaacaagaagccccgcatctgcacccgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctccacaagcagggcaagtgcgccacgtgcgtctacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagccggagcacgcgctgctggccaaggccatcttcaagctcacctaccagaacaaggtggtccgcgtgcagcggcccgccaagaacggcaccgtgatggacgtcatctcccgccgggaccagcgcgggagcggccaggtgggcacctacgggctgaacacgttcaccaacatggaggcccagctgatccggcagatggagtccgagggcatcttcagcccctccgagctcgagacccccaacctggcggagcgcgccctggactggctcgagaagtacggggtggagcggctgaagcgcatggccatcagcggcgacgactgcgtcgtgaagccgatcgacgaccggttcgccaccgccctgacggcgctcaacgacatggggaaggtgcgcaaggacatcccccagtgggagccctccaagggctggaacgactggcagcaggtccccttctgcagccaccacttccaccagctgatcatgaaggacggccgggagatcgtggtgccgtgccgcaaccaggacgagctggtcgggcgggcccgcgtgtcccagggcgccgggtggagcctccgggagaccgcctgcctgggcaagagctacgcgcagatgtggcagctgatgtacttccaccgccgggacctccgcctggccgccaacgccatctgctccgccgtgcccgtcgactgggtgcccaccagccggaccacgtggtccatccacgcgcaccaccagtggatgaccaccgaggacatgctgagcgtgtggaaccgcgtctggatcgaggagaacccctggatggaggacaagacccacatctccagctgggaggacgtgccgtacctcgggaagcgcgaggaccagtggtgcggctccctgatcggcctgacggcccgggccacctgggccaccaacatccaggtggccatcaaccaggtccgccggctcatcgggaacgagaactacctggactacatgaccagcatgaagcgcttcaagaacgagtccgaccccgagggcgcgctgtggtga

SEQ ID NO: 8720 - RNA, 9879 nt, synthetic construct
  misc_feature 1..9879: note = derived and/or modified CDS sequence (opt1) from DENV-1__EU482708__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacgcggggcgccgtcctcatgtaccaggggaagcgcctggagcccagctgggcgtccgtgaagaaggacctgatcagctacggcggcgggtggcggctccagggctcctggaacaccggggaggaggtgcaggtcatcgccgtggagcccggcaagaaccccaagaacgtgcagaccgcccccgggaccttcaagacgcccgagggcgaggtcggcgccatcgccctggacttcaagcccgggaccagcggctcccccatcgtgaaccgcgaggggaagatcgtgggcctgtacggcaacggggtcgtgaccaccagcggcacgtacgtgagcgcgatcgcccaggccaaggcctcccaggaggggccgctccccgagatcgaggacgaggtcttccggaagcgcaacctgaccatcatggacctgcaccccggcagcgggaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgcggaccgggtgatcgacccgcgccggtgcctgaagcccgtgatcctgaaggacgggcccgagcgcgtcatcctcgccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtctccggggacctgatcagcgagatcggcaagctcccgcagcacctgacccagcgcgcccagaacgccctggacaacctcgtgatgctgcacaactccgagcagggcgggcgggcctaccgccacgcgatggaggagctgcccgacacgatcgagaccctcatgctgctggccctcatcgccgtgctgaccggcggggtcaccctgttcttcctcagcggccgggggctgggcaagacctccatcggcctgctctgcgtgatggccagctccgtgctgctgtggatggccagcgtcgagccccactggatcgcggcctccatcatcctcgagttcttcctgatggtgctgctcatccccgagccggaccgccagcggacgccccaggacaaccagctggcctacgtggtcatcgggctcctcttcatgatcctgaccgtggccgccaacgagatgggcctgctcgagaccaccaagaaggacctggggatcggccacgtggcggtcgagaaccaccaccacgccgccatgctggacgtggacctccaccccgccagcgcctggacgctgtacgcggtggccaccaccatcatcaccccgatgatgcgccacacgatcgagaacaccaccgccaacatctccctgaccgccatcgccaaccaggcggccatcctcatggggctggacaagggctggcccatcagcaagatggacatcggcgtccccctgctcgccctggggtgctactcccaggtgaaccccctgacgctcaccgccgcggtgctgatgctggtcgcccactacgccatcatcggcccggggctccaggccaaggccacccgcgaggcgcagaagcggaccgccgccggcatcatgaagaaccccacggtggacgggatcgtggccatcgacctggaccccgtcgtgtacgacgccaagttcgagaagcagctgggccagatcatgctcctgatcctgtgcaccagccagatcctcctgatgcgcaccacctgggcgctgtgcgagtccatcacgctcgccaccggccccctgaccaccctgtgggaggggagcccgggcaagttctggaacacgaccatcgccgtgtccatggccaacatcttccgggggagctacctcgccggcgcgggcctggccttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtcgaccgctccgaggccaaggagggcctgaagcgcggggagaccaccaagcacgcggtgagccgcggcaccgccaagctgcggtggttcgtggagcgcaacctcgtcaagcccgaggggaaggtgatcgacctgggctgcggccgcggcgggtggtcctactactgcgccgggctgaagaaggtgacggaggtcaaggggtacaccaagggcgggcccggccacgaggagcccatcccgatggccacctacgggtggaacctggtgaagctccacagcggcaaggacgtgttcttcatcccgcccgagaagtgcgacaccctgctgtgcgacatcggggagtccagccccaacccgacgatcgaggagggccgcaccctccgggtcctgaagatggtggagccctggctgcgcgggaaccagttctgcatcaagatcctcaacccctacatgccctccgtggtcgagaccctggagcagatgcagcggaagcacggcggcatgctggtgcgcaacccgctcagccggaactccacccacgagatgtactgggtgagctgcgggaccggcaacatcgtctccgccgtgaacatgacgagccgcatgctgctgaaccgcttcaccatggcgcaccggaagcccacctacgagcgcgacgtggacctcggggccggcacccggcacgtcgccgtggagcccgaggtggccaacctggacatcatcggccagcgcatcgagaacatcaagcacgagcacaagtccacgtggcactacgacgaggacaacccctacaagacctgggcctaccacgggagctacgaggtcaagccgtccggcagcgcgagctccatggtgaacggggtcgtgaagctgctcaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctgtggggcttcctgagccgcaacaagaagccccggatctgcacccgcgaggagttcacgcggaaggtgcgctccaacgcggccatcggcgccgtgttcgtcgacgagaaccagtggaacagcgccaaggaggcggtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggtcccgggccatctggtacatgtggctcggcgcccgcttcctggagttcgaggcgctgggcttcatgaacgaggaccactggttcagccgggagaactccctcagcggggtggagggcgaggggctgcacaagctgggctacatcctccgcgacatctccaagatccccgggggcaacatgtacgccgacgacaccgccggctgggacacccggatcacggaggacgacctgcagaacgaggcccgcatcaccgacatcatggagccggagcacgccctgctcgcgcgcagcatcttcaagctgacctaccagaacaaggtggtccgggtgcagcgccccgccaagaacgggaccgtgatggacgtcatctcccggcgcgaccagcggggcagcggccaggtggggacgtacggcctgaacaccttcaccaacatggaggcccagctcatccgccagatggagtccgaggggatcttcagcccctccgagctggagacccccaacctggccgagcgggtgctcgactggctggagaagtacggcgtcgagcgcctgaagcggatggccatcagcggggacgactgcgtggtgaagccgatcgacgaccgcttcgcgacggccctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcccgggtgagccagggggccggctggtccctgcgcgagaccgcgtgcctgggcaagagctacgcccagatgtggcagctcatgtacttccaccggcgcgacctgcggctggccgccaacgcgatctgctccgccgtccccgtggactggatccccaccagccgcacgacctggtccatccacgcccaccaccagtggatgaccaccgaggacatgctcagcgtgtggaaccgcgtctggatcgaggagaacccctggatggaggacaagacgcacatctccagctggggcgacgtgccgtacctggggaagcgggaggaccagtggtgcggctccctgatcggcctcaccgcccgcgccacctgggcgaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8721 - RNA, 9879 nt, synthetic construct
  misc_feature 1..9879: note = derived and/or modified CDS sequence (opt1) from DENV-1__EU482709__SS-prME
  source 1..9879: mol_type = other RNA
agcgtgaccatgctgctgatgctggtgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtcggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtcacgccctccatggccatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggcgaagatctccaacaccacgaccgacagccgctgcccgacccagggcgaggccaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgcgccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtcttcaccagcgtggggaagctggtgcaccagatcttcggcaccgcctacggggtcctcttctccggcgtgagctggacgatgaagatcgggatcggcgtgctgctgacctggctcggcctgaactcccgcagcacctccctgagcatgacctgcatcgccgtcgggctcgtgacgctgtacctgggcgtgatggtccaggccgactccgggtgcgtgatcaactggaagggccgggagctcaagtgcgggagcggcatcttcgtgaccaacgaggtccacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtggtcgtgggggacgtggccggcatcctcgcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtcgtggtggacgagcactgcggcaaccgggggccgtccctgcgcaccaccacggtcaccggcaagatcatccacgagtggtgctgccggagctgcaccctgccgcccctccgcttccgcggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgaccggcacgctggccgtcttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtgggcctcctgttccgccggctgacctcccgcgaggtcctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtgtccctcttccccctgtgcctgagcaccacctcccagaagaccacgtggctccccgtcctgctgggcagcctcgggtgcaagccgctgaccatgttcctgatcgcggagaacaagatctggggccggcgctcctggcccctcaacgaggggatcatggccgtgggcatcgtgagcatcctgctgagctccctcctgaagaacgacgtccccctggccgggcccctcatcgccggcggcatgctgatcgcctgctacgtgatcagcgggtccagcgcggacctgtccctcgagaaggccgccgaggtgagctgggaggaggaggccgagcactccggcgccagccacaacatcctggtcgaggtgcaggacgacgggaccatgaagatcaaggacgaggagcgggacgacaccctgaccatcctcctgaaggcgacgctgctcgccgtgtccggcgtctacccgctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgccgtgctcatgtaccaggggaagcgcctggagcccagctgggcgtccgtgaagaaggacctgatcagctacggcggcgggtggcggctccagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctgtacggcaacggggtggtgaccaccagcggcacgtacgtcagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtgcgggaggccatcaagcgcaagctgcgcaccctgatcctcgcccccacgcgggtcgtggcctccgagatggccgaggcgctgaagggcatgcccatccgctaccagaccaccgccgtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtcctgaccggcggggtgaccctcttcttcctgtccggccgggggctgggcaagaccagcatcggcctcctgtgcgtgatggcctccagcgtcctgctctggatggcctccgtggagccccactggatcgcggccagcatcatcctggagttcttcctgatggtgctcctgatccccgagccggaccgccagcggacgccccaggacaaccagctggcctacgtcgtgatcgggctcctgttcatgatcctgaccgtggccgccaacgagatgggcctcctggagaccaccaagaaggacctggggatcggccacgtcgcggtggagaaccaccaccacgccgccatgctcgacgtggacctgcaccccgcctccgcctggacgctgtacgcggtcgccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtgaaccccctcacgctgaccgccgcggtcctgatgctcgtggcccactacgccatcatcggcccggggctgcaggccaaggccacccgcgaggcgcagaagcggaccgccgccggcatcatgaagaaccccacggtggacgggatcgtcgccatcgacctggaccccgtggtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtcagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtgtcccgcggcaccgccaagctccggtggttcgtcgagcgcaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggccacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacgtcccgcatgctgctcaaccgcttcaccatggcgcaccggaagcccacctacgagcgcgacgtcgacctgggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctcctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctctcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtcgtgcgcgtgcagcggcccgccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtcctggactggctggagaagtacggcgtggagcggctcaagcgcatggccatctccggggacgactgcgtggtcaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcccgcgtcagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctggggaagcgcgaggaccagtggtgcggcagcctcatcggcctgaccgcccgggccacctgggcgaccaacatccaggtcgccatcaaccaggtgcgccggctgatcgggaacgagaactacctcgactacatgacctccatgaagcgcttcaagaacgagagcgaccccgagggcgccctgtggtga

SEQ ID NO: 8722 - RNA, 9879 nt, synthetic construct
  misc_feature 1..9879: note = derived and/or modified CDS sequence (opt1) from DENV-1__EU482710__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagcacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaaccaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtgggcctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcagcgagatcggcaagctgccgcagcacctcacccagcgcgcgcagaacgccctggacaacctggtcatgctccacaactccgagcagggcgggcgggcctaccgccacgccatggaggagctgcccgacacgatcgagaccctgatgctcctggcgctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgccgcgtccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggccgtggagaaccaccaccacgcgacgatgctggacgtcgacctgcaccccgccagcgcctggaccctctacgccgtggccaccaccatcatcacgccgatgatgcgccacaccatcgagaacaccaccgcgaacatctccctgacggccatcgccaaccaggccgccatcctgatggggctcgacaagggctggcccatcagcaagatggacatcggcgtgcccctgctggcgctcgggtgctactcccaggtcaaccccctgaccctgaccgccgccgtgctcatgctggtggcccactacgcgatcatcggcccggggctgcaggccaaggccacccgggaggcccagaagcgcacggccgcgggcatcatgaagaaccccaccgtcgacgggatcatcgccatcgacctcgaccccgtggtgtacgacgccaagttcgagaagcagctgggccagatcatgctgctcatcctgtgcaccagccagatcctgctcatgcgcaccacgtgggccctgtgcgagtccatcaccctggccaccggccccctcaccacgctgtgggaggggagcccgggcaagttctggaacaccaccatcgcggtctccatggccaacatcttccgggggagctacctggccggcgccggcctcgccttcagcctgatgaagtccctcgggggcgggcgccgggggaccggggcgcagggcgagacgctcggcgagaagtggaagcgccagctgaaccagctgagcaagtccgagttcaacatctacaagcggagcgggatcatggaggtggaccgctccgaggccaaggagggcctcaagcgcggggagaccacccgccacgccgtgagccggggcaccgccaagctgcgctggttcgtcgagcggaacctggtgaagcccgaggggaaggtgatcgacctgggctgcggccgcgggggctggtcctactactgcgcggggctcaagaaggtcacggaggtgaagggctacaccaagggcgggcccggccacgaggagcccatcccgatggccacctacgggtggaacctggtgaagctgcacagcggcaaggacgtcttcttcacgccgcccgagaagtgcgacacgctcctgtgcgacatcggggagtccagccccaacccgaccatcgaggagggccggaccctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggacgggcaacatcgtgtccgccgtgaacatgaccagccggatgctcctgaaccgcttcaccatggcccaccgcaagcccacctacgagcgggacgtcgacctgggggccggcacgcgccacgtggcggtggagcccgaggtcgccaacctcgacatcatcggccagcggatcgagaacatcaagcacgagcacaagtccacctggcactacgacgaggacaacccctacaagacctgggcctaccacgggagctacgaggtgaagccgtccggcagcgccagctccatggtcaacggggtggtgaagctgctgaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctctggggcttcctgagccgcaacaagaagccccggatctgcacgcgcgaggagttcacccggaaggtgcgctccaacgccgccatcggcgcggtcttcgtggacgagaaccagtggaacagcgccaaggaggccgtggaggacgagcggttctgggacctggtccagaaggagcgcgagctccacaagcaggggaagtgcgcgacctgcgtgtacaacatgatgggcaagcgggagaagaagctgggggagttcggcaaggcgaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacaccgcgggctgggacacgcgcatcaccgaggacgacctccagaacgaggccaagatcaccgacatcatggagccggagcacgccctgctggccaccagcatcttcaagctcacgtaccagaacaaggtcgtgcgggtgcagcgccccgccaagaacgggaccgtcatggacgtgatctcccgccgggaccagcgcggcagcggccaggtgggcacctacggcctgaacaccttcacgaacatggaggcgcagctgatccggcagatggagtccgaggggatcttcctccccagcgagctggagacccccaacctggccgagcgcgtcctcgactggctggagaagtacggcgtggagcggctgaagcgcatggccatctccggggacgactgcgtggtcaagccgatcgacgaccggttcgccaccgccctcaccgcgctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagacggcctgcctggggaagtcctacgcccagatgtggcagctcatgtacttccaccgccgggacctgcgcctggcggccaacgccatctgcagcgccgtgcccgtggactgggtccccacctcccggaccacctggagcatccacgcgcaccaccagtggatgacgaccgaggacatgctctccgtgtggaaccgcgtgtggatcgaggagaacccctggatggaggacaagacccacgtcagctcctggggcgacgtgccgtacctggggaagcgggaggaccagtggtgcggcagcctgatcggcctcaccgcccgcgccacctgggcctccaacatccaggtggccatcaaccaggtccgccggctgatcgggaacgagaactacctggactacatgacgagcatgaagcgcttcaagaacgagggcgaccccgagggggcgctctggtga

SEQ ID NO: 8723 - RNA, 9879 nt, synthetic construct
  misc_feature 1..9879: note = derived and/or modified CDS sequence (opt1) from DENV-1__EU482712__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagaactacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgctgttcctgctcatcatggggcagctgacgtggaacgacctgatccggctctgcatcatggtcggcgcgaacgcctccgaccgcatggggatgggcaccacctacctggccctgatggccaccttcaagatgcgcccgatgttcgccgtgggcctcctgttccggcgcctgacgagccgggaggtgctcctgctgaccatcgggctctccctggtcgcgagcgtggagctgcccaactccctcgaggagctgggcgacgggctggccatgggcatcatgatcctcaagctgctgaccgacttccagagccaccagctctgggccaccctgctgtccctcacgttcatcaagaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgggacgacaccctgaccatcctcctgaaggccaccctgctcgccgtgagcggcgtgtacccgctgtccatccccgccacgctgttcgtctggtacttctggcagaagaagaagcagcgcagcggggtgctctgggacacccccagcccgcccgaggtggagcgggccgtcctggacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacacgggggaggaggtgcaggtcatcgccgtggagcccggcaagaaccccaagaacgtgcagaccgcccccgggaccttcaagacctccgagggcgaggtcggcgccatcgcgctggacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctcccggagatcgaggacgaggtcttccggaagcgcaacctgacgatcatggacctgcaccccggcagcgggaagacccggcgctacctccccgccatcgtgcgggaggccatcaagcgcaagctgcggaccctgatcctcgccccgacccgcgtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagaccttcgacacggagtaccagaagaccaagaacaacgactgggactacgtggtcaccaccgacatcagcgagatgggcgcgaacttccgcgccgaccgggtgatcgacccccgccggtgcctgaagccggtgatcctgaaggacgggcccgagcgcgtcatcctcgccggccccatgcccgtgacggtcgcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcacccccatgatgcgccacaccatcgagaacacgaccgccaacatcagcctcaccgccatcgcgaaccaggccgccatcctgatggggctggacaagggctggccgatctccaagatggacatcggcgtccccctcctggccctggggtgctacagccaggtgaaccccctcaccctgacggcggccgtgctgatgctcgtcgcccactacgccatcatcggccccgggctgcaggccaaggcgacccgggaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtcccccggcaagttctggaacaccacgatcgccgtgagcatggccaacatcttccgggggagctacctggcgggcgccggcctggccttctccctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctcgtgaagctgcactccggcaaggacgtgttcttcatcccgcccgagaagtgcgacaccctgctctgcgacatcggggagagctcccccaaccccaccatcgaggagggccgcacgctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacccacgagatgtactgggtgtcctgcgggaccggcaacatcgtcagcgcggtgaacatgacctcccgcatgctgctcaaccggttcacgatggcccaccgcaagccgacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctcctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctctcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagcccgagcacgcgctcctggccaagtccatcttcaagctgacctaccagaacaaggtggtccgcgtgcagcggccggccaagaacgggaccgtgatggacgtcatcagccgccgcgaccagcggggctccggccaggtgggcacctacggcctcaacacgttcaccaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccaccgccctgacggccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccctacctgggcaagcgcgaggaccagtggtgcggcagcctcatcgggctgacggcccgggcgacctgggccaccaacatccaggtcgccatcaaccaggtgcgccgcctgatcggcaacgagaactacctcgactacatgacctccatgaagcggttcaagaacgagagcgacccggagggggccctgtggtga

SEQ ID NO: 8724 - RNA, 9879 nt, synthetic construct
  misc_feature 1..9879: note = derived and/or modified CDS sequence (opt1) from DENV-1__EU249490__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccgcacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggcgcaccttcgacacggagtaccagaagaccaagaacaacgactgggactacgtggtcaccaccgacatcagcgagatgggcgcgaacttccgggccgaccgcgtgatcgacccccggcgctgcctcaagccggtgatcctgaaggacgggcccgagcgggtcatcctggccggccccatgcccgtgacggtcgcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccgcctgcggggcgaggcccgcaagaccttcgtggagctgatgcggcgcggggacctcccggtgtggctgagctacaaggtcgcctccgagggcttccagtacagcgaccggcgctggtgcttcgacggcgagcggaacaaccaggtgctggaggagaacatggacgtggagatctggacgaaggagggggagcgcaagaagctccggccccgctggctggacgcccggacctactccgaccccctggccctccgcgagttcaaggagttcgcggccggccggcgcagcgtctccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagacgctcatgctgctggccctcatcgccgtgctgaccggcggggtcaccctgttcttcctctccggccgcgggctgggcaagaccagcatcggcctgctctgcgtgatggcctccagcgcgctgctgtggatggcctccgtggagccccactggatcgccgccagcatcatcctcgagttcttcctgatggtcctgctcatccccgagcccgaccggcagcgcaccccgcaggacaaccagctggcctacgtggtgatcgggctcctcttcatgatcctgacggtcgcggccaacgagatgggcctgctcgagaccaccaagaaggacctggggatcggccacgtggccgtggagaaccaccaccacgccgccatgctggacgtcgacctccaccccgcgtccgcctggaccctgtacgccgtggccacgaccatcatcacccccatgatgcggcacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgcgaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcggaccacctgggccctgtgcgagagcatcaccctcgccacgggccccctgaccaccctgtgggaggggtcccccggcaagttctggaacaccacgatcgccgtgagcatggcgaacatcttccgcgggagctacctcgccggcgccggcctggccttctccctgatgaagtccctcgggggcgggcggcgcggcaccggggcgcagggcgagaccctgggcgagaagtggaagcggcagctgaaccagctctccaagagcgagttcaacacctacaagcgctccgggatcatggaggtggaccggagcgaggccaaggagggcctgaagcgcggggagacgaccaagcacgccgtctcccggggcaccgccaagctgcgctggttcgtggagcggaacctcgtgaagccggaggggaaggtcatcgacctgggctgcggccgcgggggctggagctactactgcgccgggctgaagaaggtgaccgaggtgaagggctacacgaagggcgggcccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccggacgctccgcgtgctgaagatggtcgagccgtggctgcgggggaaccagttctgcatcaagatcctcaacccctacatgcccagcgtggtggagaccctggagcagatgcagcgcaagcacggcggcatgctggtccggaaccccctctcccgcaacagcacccacgagatgtactgggtgtcctgcgggaccggcaacatcgtgagcgccgtcaacatgacctcccggatgctgctgaaccgcttcacgatggcccaccgcaagccgacctacgagcgggacgtggacctcggggccggcacccgccacgtggccgtcgagcccgaggtggcgaacctggacatcatcggccagcggatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgcgtcttcaaggagaaggtggacacccggacccccaaggccaagcgcgggacggcgcagatcatggaggtgaccgccaagtggctgtggggcttcctgtcccggaacaagaagccgcgcatctgcacccgggaggagttcacccgcaaggtccggagcaacgccgccatcggcgcggtgttcgtggacgagaaccagtggaactccgccaaggaggccgtcgaggacgagcgcttctgggacctcgtgcaccgggagcgcgagctgcacaagcaggggaagtgcgccacgtgcgtgtacaacatgatgggcaagcgggagaagaagctgggggagttcggcaaggccaaggggagccgcgcgatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgccgacgacaccgccggctgggacacccgcatcaccgaggacgacctgcagaacgaggcgaagatcacggacatcatggagcccgagcacgccctgctcgccaagtccatcttcaagctgacctaccagaacaaggtggtgcgggtccagcgcccggccaagaacgggaccgtgatggacgtgatcagccgccgggaccagcgcggctccgggcaggtcggcacctacggcctgaacacgttcaccaacatggaggcccagctcatccggcagatggagagcgaggggatcttctcccccagcgagctggagacccccaacctggcgggccgcgtgctcgactggctggagaagcacggggtggagcggctgaagcgcatggccatctccggcgacgactgcgtcgtgaagcccatcgacgaccggttcgccaccgccctcacggccctgaacgacatggggaaggtgcgcaaggacatcccgcagtgggagcccagcaagggctggaacgactggcagcaggtccccttctgcagccaccacttccaccagctgatcatgaaggacggccgggagatcgtggtgccctgccgcaaccaggacgagctcgtcgggcgggcgcgcgtgtcccagggcgccgggtggagcctgcgggagaccgcctgcctgggcaagtcctacgcccagatgtggcagctcatgtacttccaccgccgggacctgcgcctggcggccaacgccatctgcagcgccgtgccggtcgactgggtgcccacctcccggaccacgtggagcatccacgcccaccaccagtggatgaccaccgaggacatgctctccgtgtggaaccgcgtctggatcgaggagaacccctggatggaggacaagacccacatcagctcctggggcgacgtgccctacctgggcaagcgggaggaccagtggtgcggcagcctgatcgggctcacggcgcgcgccacctgggccaccaacatccaggtggccatcaaccaggtccgccggctgatcggcaacgagaactacctggactacatgacctccatgaagcgcttcaagaacgagagcgacccggagggggccctctggtga

SEQ ID NO: 8725 - RNA, 9879 nt, synthetic construct
  misc_feature 1..9879: note = derived and/or modified CDS sequence (opt1) from DENV-1__EU249491__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgccatggtgcaggcggactccgggtgcgtgatcaactggaagggccgggagctcaagtgcgggagcggcatcttcgtcacgaacgaggtgcacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagctcaccgtcgtggtgggggacgtcgccggcatcctggggcagggcaagaagatgatccggccccagcccatggagtacaagtacagctggaagtcctggggcaaggccaagatcatcggggccgacgcgcagaacacgaccttcatcatcgacggccccaacaccccggagtgccccgacgaccagcgcgcctggaacatctgggaggtggaggactacgggttcggcatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggggtgctggagtccgagatgatcatccccaagatctacggcgggccgatcagccagcacaactaccgccccggctacttcacccagaccgccgggccctggcacctgggcaagctcgagctggacttcgacctgtgcgagggcaccacggtcgtggtggacgagcactgcgggaaccggggcccgtccctccgcaccaccaccgtcacggggaagatcatccacgagtggtgctgccggagctgcaccctgccgcccctgcgcttccggggcgaggacgggtgctggtacggcatggagatccgccccgtgaaggagaaggaggagaacctcgtgaagtccatggtcagcgccggcagcggggaggtggactccttcagcctgggcctgctctgcatctccatcatgatcgaggaggtgatgcggagccgctggtcccggaagatgctgatgaccgggaccctggcggtcttcttcctcctgatcatgggccagctgacgtggaacgacctcatccgcctgtgcatcatggtgggggccaacgccagcgaccgcatgggcatgggcaccacctacctggccctcatggccaccttcaagatgcggccgatgttcgcggtggggctgctgttccgccggctcacgtcccgcgaggtcctgctgctcaccatcggcctgagcctggtggcctccgtggagctccccaacagcctggaggagctgggggacggcctcgccatgggcatcatgatcctgaagctgctcaccgacttccagtcccaccagctgtgggccaccctgctcagcctgacgttcatcaagaccaccttctccctgcactacgcgtggaagaccatggccatggtcctcagcatcgtgtccctgttccccctgtgcctcagcacgacctcccagaagaccacctggctgcccgtcctgctcgggagcctgggctgcaagccgctgacgatgttcctcatcgccgagaacaagatctgggggcggaagtcctggcccctgaacgagggcatcatggccgtggggatcgtgagcatcctgctcagctccctgctgaagaacgacgtccccctcgccggccccctgatcgcgggcgggatgctgatcgcctgctacgtgatcagcggctccagcgccgacctctccctggagaaggccgccgaggtgagctgggaggaggaggcggagcactccggggccagccacaacatcctggtcgaggtgcaggacgacggcaccatgaagatcaaggacgaggagcgcgacgacaccctcaccatcctgctgaaggccaccctcctggccgtgtccggggtctacccgctgagcatccccgccaccctcttcgtgtggtacttctggcagaagaagaagcagcggtccggcgtgctgtgggacacccccagcccgcccgaggtcgagcgcgcggtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcctccgtgaagaaggacctcatcagctacggcgggggctggcgcctgcgggggtcctggaacacgggcgaggaggtccaggtgatcgccgtggagcccgggaagaaccccaagaacgtccagaccgcccccggcaccttcaagacccccgagggcgaggtgggggcgatcgccctggacttcaagcccggcacgagcgggtcccccatcgtgaaccgcgagggcaagatcgtcggcctctacgggaacggcgtggtgaccaccagcgggacctacgtcagcgccatcgcccaggcgaaggcctcccaggagggcccgctgcccgagatcgaggacgaggtgttccggaagcgcaacctgacgatcatggacctccaccccgggagcggcaagacccggcgctacctgccggccatcgtgcgggaggccatcaagcgcaagctgcgcaccctcatcctggcccccacccgggtcgtggcgtccgagatggccgaggccctgaagggcatgcccatccgctaccagacgaccgccgtcaagagcgagcacaccgggaaggagatcgtcgacctcatgtgccacgccaccttcacgatgcggctgctgtcccccgtgcgcgtgccgaactacaacatgatcatcatggacgaggcgcacttcaccgaccccagctccatcgccgcccggggctacatcagcacccgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgcgaactgcctccggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccgcgccggtgcctgaagcccgtcatcctcaaggacggccccgagcgcgtgatcctggccgggcccatgccggtgacggtcgcctccgcggcccagcggcgcggccggatcggccgcaaccacaacaaggagggggaccagtacatctacatgggccagcccctgaacaacgacgaggaccacgcccactggaccgaggccaagatgctcctggacaacatcaacacccccgaggggatcatccccgccctgttcgagccggagcgcgagaagtccgcggccgtggacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggacgaaggagggcgagcggaagaagctgcgcccccggtggctcgacgcccgcacctactccgaccccctggcgctgcgggagttcaaggagttcgccgccgggcgccggagcgtgtccggcgacctcatcctggagatcggcaagctgccgcagcacctcacccagcgcgcccagaacgcgctggacaacctggtcatgctccacaacagcgagcagggcgggcgggcctaccgccacgccatggaggagctgcccgacaccatcgagacgctgatgctcctggccctgatcgccgtgctcaccgggggcgtgaccctgttcttcctgtccgggcggggcctcggcaagaccagcatcgggctgctgtgcgtcatggcgtccagcgtgctcctgtggatggcctccgtggagccccactggatcgccgccagcatcatcctggagttcttcctcatggtcctgctgatccccgagccggaccgccagcggacgccccaggacaaccagctcgcctacgtggtgatcggcctgctgttcatgatcctcacggtcgcggccaacgagatggggctgctggagaccaccaagaaggacctcggcatcgggcacgtggccgtggagaaccaccaccacgccgccatgctggacgtcgacctgcaccccgcgtccgcctggaccctctacgccgtggccacgaccatcatcaccccgatgatgcgccacaccatcgagaacacgaccgccaacatcagcctgaccgcgatcgccaaccaggccgccatcctgatgggcctcgacaagggctggcccatctccaagatggacatcggggtgcccctgctggcgctcggctgctacagccaggtcaaccccctgaccctgacggccgccgtgctcatgctggtggcccactacgccatcatcgggccgggcctgcaggcgaaggccacccgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggcgaacatcttccggggctcctacctggccggcgccgggctcgccttcagcctgatgaagtccctgggcgggggccgccgggggaccggcgcgcagggcgagaccctcggggagaagtggaagcgccagctgaaccagctgtccaagagcgagttcaacacctacaagcggtccggcatcatggaggtggaccgcagcgaggccaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggcgacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgccgtcaacatgacctcccgcatgctcctgaaccgcttcacgatggcccaccggaagcccacctacgagcgcgacgtggacctgggcaccggcacccggcacgtggccgtcgagcccgaggtggccaacctcgacatcatcgggcagcgcatcgagaacatcaagcacgagcacaagagcacgtggcactacgacgaggacaacccctacaagacctgggcgtaccacggctcctacgaggtgaagccgagcgggtccgccagcagcatggtcaacggcgtggtcaagctgctgaccaagccctgggacgtgatccccatggtgacccagatcgccatgacggacaccacccccttcgggcagcagcgggtcttcaaggagaaggtggacacccgcacgccgaaggccaagcggggcaccgcccagatcatggaggtgaccgcgcgctggctctggggcttcctgtcccggaacaagaagccccgcatctgcacccgggaggagttcacgcgcaaggtccggagcaacgccgccatcggggccgtgttcgtggacgagaaccagtggaactccgcgaaggaggccgtcgaggacgagcgcttctgggacctggtgcaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcacggaggacgacctccagaacgaggccaagatcaccgacatcatggagccggagcacgcgctgctggccaaggccatcttcaagctcacctaccagaacaaggtggtgcgcgtccagcggcccgccaagaacggcaccgtgatggacgtgatctcccgccgggaccagcgcgggagcggccaggtcggcacgtacgggctgaacaccttcaccaacatggaggcccagctgatccggcagatggagtccgagggcatcttcagcccctccgagctcgagacccccaacctggcggagcgcgccctggactggctcgagaagtacggggtggagcggctgaagcgcatggccatcagcggcgacgactgcgtggtcaagccgatcgacgaccggttcgccacggccctgaccgcgctcaacgacatggggaaggtgcgcaaggacatcccccagtgggagccctccaagggctggaacgactggcagcaggtccccttctgcagccaccacttccaccagctgatcatgaaggacggccgggagatcgtcgtgccgtgccgcaaccaggacgagctggtggggcgggcccgcgtctcccagggcgccgggtggagcctccgggagaccgcctgcctgggcaagagctacgcgcagatgtggcagctgatgtacttccaccgccgggacctccgcctggccgccaacgccatctgctccgccgtgcccgtggactgggtccccaccagccggacgacctggtccatccacgcgcaccaccagtggatgaccaccgaggacatgctgagcgtgtggaaccgcgtgtggatcgaggagaacccctggatggaggacaagacgcacatctccagctgggaggacgtcccgtacctcgggaagcgcgaggaccagtggtgcggctccctgatcggcctgaccgcccgggccacctgggccaccaacatccaggtggccatcaaccaggtgcgccggctcatcgggaacgagaactacctggactacatgaccagcatgaagcgcttcaagaacgagtccgaccccgagggcgcgctgtggtga

SEQ ID NO: 8726 - RNA, 9879 nt, synthetic construct
  misc_feature 1..9879: note = derived and/or modified CDS sequence (opt1) from DENV-1__EU249492__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacgcagatgtgcgaccaccgcctcatgagcgccgccatcaaggactccaaggccgtgcacgccgacatgggctactggatcgagagcgagaagaacgagacctggaagctggcgcgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggctctgcatcatggtgggcgcgaacgcctccgaccgcatggggatgggcacgacctacctggccctgatggccaccttcaagatgcgcccgatgttcgccgtcgggctcctgttccggcgcctgaccagccgggaggtgctcctgctgacgatcgggctctccctggtggcgagcgtcgagctgcccaactccctcgaggagctgggcgacgggctggccatgggcatcatgatcctcaagctgctgaccgacttccagagccaccagctctgggccaccctgctgtccatgaccttcatccgcacgaccttcagcctccactacgcctggaagaccatggcgatggtgctgtccatcgtcagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgccggcggcatgctcatcgcgtgctacgtgatctccgggagctccgccgacctgagcctggagaaggccgccgaggtctcctgggaggaggaggccgagcacagcggcgcgtcccacaacatcctcgtggaggtgcaggacgacgggacgatgaagatcaaggacgaggagcgcgacgacaccctgaccatcctgctcaaggccaccctgctggccgtcagcggcgtgtacccgctctccatccccgccaccctgttcgtgtggtacttctggcagaagaagaagcagcggagcggggtcctgtgggacacgcccagcccgcccgaggtgcagcgcgccgtgctcgacgacggcatctaccggatcatgcagcgcggcctgctggggcggagccaggtcggcgtgggggtgttccaggagaacgtcttccacaccatgtggcacgtgacccgcggcgcggtgctgatgtaccaggggaagcggctcgagccctcctgggccagcgtcaagaaggacctgatctcctacggcggcgggtggcgcctgcagggcagctggaacaccggggaggaggtccaggtgatcgccgtcgagcccggcaagaaccccaagaacgtgcagacggcccccgggaccttcaagacctccgagggcgaggtgggcgccatcgcgctcgacttcaagcccgggaccagcggcagccccatcgtcaaccgggaggggaagatcgtgggcctgtacggcaacggggtggtcacgacctccggcacctacgtgagcgccatcgcccaggccaaggcgtcccaggaggggcccctgccggagatcgaggacgaggtgttccgcaagcggaacctcaccatcatggacctgcaccccggcagcgggaagacgcgccggtacctgcccgccatcgtccgcgaggccatcaagcggaagctccgcaccctgatcctggccccgacccgcgtggtggcctccgagatggcggaggccctcaagggcatgcccatccggtaccagaccacggccgtcaagagcgagcacaccggcaaggagatcgtggacctgatgtgccacgccaccttcaccatgcgcctgctctcccccgtgcgggtccccaactacaacatgatcatcatggacgaggcccacttcacggacccgagctccatcgcggcccgcgggtacatcagcacccgggtgggcatgggggaggccgccgccatcttcatgaccgcgacgccgcccggctccgtggaggccttcccccagagcaacgccgtcatccaggacgaggagcgcgacatcccggagcggtcctggaacagcgggtacgagtggatcacggacttccccggcaagaccgtgtggttcgtgccctccatcaagagcggcaacgacatcgccaactgcctgcgcaagaacgggaagcgggtcatccagctgtcccgcaagaccttcgacaccgagtaccagaagacgaagaacaacgactgggactacgtggtgaccaccgacatcagcgagatgggcgcgaacttccgggccgaccgcgtcatcgacccccggcgctgcctcaagccggtgatcctgaaggacgggcccgagcgggtgatcctggccggccccatgcccgtcaccgtggcctccgccgcgcagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccgcctgcggggcgaggcccgcaagaccttcgtcgagctgatgcggcgcggggacctcccggtgtggctgagctacaaggtggcctccgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacgtactccgaccccctggccctccgcgagttcaaggagttcgcggccggccggcgcagcgtgtccggggacctgatcctggagatcggcaagctcccccagcacctgacccagcgggcccagaacgccctggacaacctcgtcatgctgcacaacagcgagcagggcgggcgcgcgtaccggcacgccatggaggagctgccggacaccatcgagaccctcatgctgctggccctcatcgccgtgctgacgggcggggtgaccctgttcttcctctccggccgcgggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccggcagcgcaccccgcaggacaaccagctggcctacgtggtgatcgggctcctgttcatgatcctgaccgtcgccgcgaacgagatgggcctgctcgagacgaccaagaaggacctggggatcggccacgtggccgtggagaaccaccaccacgccgccatgctggacgtcgacctccaccccgcctccgcgtggaccctgtacgccgtggccaccacgatcatcacccccatgatgcggcacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtcaaccccctgaccctcaccgcggccgtgctgatgctggtggcccactacgccatcatcggccccgggctccaggccaaggcgacgcgcgaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacctcccagatcctcctgatgcggacgacctgggccctgtgcgagagcatcaccctcgccaccggccccctgacgaccctgtgggaggggtcccccggcaagttctggaacaccaccatcgccgtgagcatggccaacatcttccgcgggagctacctcgcgggcgccggcctggccttctccctgatgaagtccctcgggggctcccggcgcgggacgggcgcccagggggagaccctgggcgagaagtggaagcggcagctgaaccagctcagcaagtccgagttcaacacctacaagcgcagcggcatcatggaggtggaccggtccgaggcgaaggaggggctgaagcgcggcgagaccacgaagcacgccgtcagccgggggaccgccaagctgcgctggttcgtggagcggaacctcgtgaagccggagggcaaggtcatcgacctggggtgcggccgcggcgggtggtcctactactgcgccggcctgaagaaggtgaccgaggtgaaggggtacaccaagggcgggcccggccacgaggagcccatccccatggccacgtacggctggaacctggtcaagctccacagcgggaaggacgtgttcttcatcccgcccgagaagtgcgacaccctgctgtgcgacatcggcgagtccagccccaaccccaccatcgaggaggggcggaccctccgcgtgctgaagatggtcgagccgtggctgcggggcaaccagttctgcatcaagatcctcaacccctacatgccctccgtggtggagacgctggagcagatgcagcgcaagcacgggggcatgctggtccggaaccccctcagccgcaactccacccacgagatgtactgggtgagctgcggcaccgggaacatcgtgtccgcggtcaacatgaccagccggatgctgctgaaccgcttcaccatggcccaccgcaagccgacgtacgagcgggacgtggacctcggcgccgggacccgccacgtggccgtcgagcccgaggtggccaacctggacatcatcggccagcggatcgagaacatcaagcacgagcacaagtccacctggcactacgacgaggacaacccctacaagacctgggcgtaccacggcagctacgaggtgaagcccagcgggtccgccagctccatggtcaacggcgtggtcaagctgctcacgaagccgtgggacgtgatccccatggtgacccagatcgccatgaccgacaccacgcccttcgggcagcagcgcgtcttcaaggagaaggtggacacccggacccccaaggccaagcgcggcaccgcccagatcatggaggtgacggcgaagtggctgtgggggttcctgagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggggcgcggttcctggagttcgaggccctgggcttcatgaacgaggaccactggttcagccgcgagaactccctcagcggcgtcgagggggagggcctgcacaagctggggtacatcctccgggacatctccaagatccccggcgggaacatgtacgccgacgacacggccggctgggacacccgcatcaccgaggacgacctgcagaacgaggccaagatcaccgacatcatggagcccgagcacgcgctgctcgccaagagcatcttcaagctgacgtaccagaacaaggtggtgcgggtccagcgcccggccaagaacggcaccgtgatggacgtgatctcccgccgggaccagcgcgggagcggccaggtcgggacctacggcctgaacaccttcacgaacatggaggcccagctcatccggcagatggagtccgagggcatcttcagcccctccgagctggacacccccaacctggccgggcgcgtgctcgactggctggagaagcacggcgtggagcggctgaagcgcatggcgatcagcggggacgactgcgtcgtgaagcccatcgacgaccggttcgccaccgccctcaccgccctgaacgacatgggcaaggtgcgcaaggacatcccgcagtgggagcccagcaaggggtggaacgactggcagcaggtccccttctgctcccaccacttccaccagctgatcatgaaggacggccgggagatcgtggtgccctgccgcaaccaggacgagctcgtcggccgggcccgcgtgagccagggggcgggctggtccctgcgggagacggcctgcctgggcaagagctacgcccagatgtggcagctcatgtacttccaccgccgggacctgcgcctggccgcgaacgccatctgctccgccgtgccggtcgactgggtgcccaccagccggaccacctggtccatccacgcccaccaccagtggatgacgaccgaggacatgctcagcgtgtggaaccgcgtctggatcgaggagaacccctggatggaggacaagacccacatctccagctggggcgacgtgccctacctggggaagcgggaggaccagtggtgcggctccctgatcggcctcaccgcccgcgcgacgtgggccaccaacatccaggtggccatcaaccaggtccgccggctgctggggaacgagaactacctcgactacatgaccagcatgaagcgcttcaagaacgagtccggcccggagggggccctgtggtga

SEQ ID NO: 8727 - RNA, 9879 nt, synthetic construct
  misc_feature 1..9879: note = derived and/or modified CDS sequence (opt1) from DENV-1__EU249493__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgacaccgcctgcctgggcaagtcctacgcccagatgtggcagctcatgtacttccaccggcgcgacctgcggctggccgcgaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8728 - RNA, 9879 nt, synthetic construct
  misc_feature 1..9879: note = derived and/or modified CDS sequence (opt1) from DENV-1__EU249494__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgccatggtccaggcggactccgggtgcgtgatcaactggaagggccgggagctcaagtgcgggagcggcatcttcgtgacgaacgaggtccacacctggaccgagcagtacaagttccaggccgacagcccgaagcgcctgtccgccgccatcggcaaggcctgggaggagggggtgtgcggcatccggagcgcgacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacgtggaacgacctcatccggctgtgcatcatggtgggcgcgaacgccagcgaccgcatggggatgggcaccacctacctggccctcatggccaccttcaagatgcgcccgatgttcgccgtcgggctgctgttccggcgcctcacgtcccgggaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccctgtccctccactacgcctggaagaccatggcgatggtgctgagcatcgtctccctgttccccctctgcctgagcacgacctcccagaagaccacctggctgcccgtgctcctgggcagcctggggtgcaagccgctcacgatgttcctgatcgccgagaacaagatctggggccgcaagtcctggcccctgaacgaggggatcatggccgtgggcgtcgtgagcatcctcctgagctccctgctcaagaacgacgtgcccctggccgggcccctgatcgccggcggcatgctcatcgcgtgctacgtcatcagcgggtccagcgccgacctgtccctggagaaggccgccgaggtgagctgggaggaggaggccgagcactccggcgcgagccacaacatcctcgtggaggtccaggacgacgggaccatgaagatcaaggacgaggagcgggacgacaccctgaccatcctgctcaaggccaccctgctggccgtgtccggcgtgtacccgctcagcatccccgccacgctgttcgtctggtacttctggcagaagaagaagcagcgctccggggtgctgtgggacacccccagcccgcccgaggtggagcgggccgtcctggacgacggcatctaccgcatcatgcagcggggcctcctggggcgctcccaggtgggcgtgggggtcttccaggagaacgtgttccacaccatgtggcacgtgacccggggcgcggtcctgatgtaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgcgctcgacttcaagcccgggacgagcggctcccccatcgtgaaccgcgaggggaagatcgtgggcctgtacggcaacggggtcgtgaccaccagcggcacctacgtgagcgccatcgcccaggccaaggcgtcccaggaggggccgctgcccgagatcgaggacgaggtcttccggaagcgcaacctcacgatcatggacctgcaccccggcagcgggaagacccggcgctacctgccggccatcgtgcgggaggccatcaagcgcaagctccggaccctgatcctggcccccacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccgcgccggtgcctcaagcccgtgatcctgaaggacgggcccgagcgcgtcatcctggccggccccatgccggtgacggtcgcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgggagaagtccgccgcgatcgacggggagtaccgcctgcgcggcgaggcccggaagaccttcgtggagctgatgcgccgcggggacctccccgtgtggctgtcctacaaggtcgccagcgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagccggaccgccagcggacgccccaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccaccatgctggacgtggacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtccccctgctcgccctggggtgctacagccaggtgaaccccctgacgctcaccgccgcggtgctgatgctggtcgcccactacgccatcatcggcccggggctccaggccaaggccacccgggaggcgcagaagcgcaccgccgccggcatcatgaagaaccccacggtggacgggatcgtggccatcgacctggaccccgtcgtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtcgaccgcagcgaggccaaggagggcctgaagcgcggggagacgacccgccacgcggtgtcccggggcaccgccaagctgcgctggttcgtggagcggaacctggtcaagcccgaggggaaggtgatcgacctcggctgcggccgcgggggctggagctactactgcgccgggctgaagaaggtgaccgaggtcaagggctacacgaagggcgggcccggccacgaggagcccatcccgatggccacctacgggtggaacctggtgaagctccactccggcaaggacgtgttcttcacgccgcccgagaagtgcgacaccctgctgtgcgacatcggggagagctcccccaacccgacgatcgaggagggccggaccctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacgtcccggatgctgctgaaccgcttcaccatggcgcaccgcaagcccacctacgagcgggacgtggacctcggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctcaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgcccggtggctgtggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctcgtgcagaaggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatccccgggggcaacatgtacgccgacgacaccgccggctgggacacccgcatcacggaggacgacctgcagaacgaggccaagatcaccgacatcatggagccggagcacgccctgctcgcgacctccatcttcaagctgacctaccagaacaaggtggtccgggtgcagcgccccgccaagaacgggacggtgatggacgtcatcagccgccgggaccagcgcggctccggccaggtgggcacctacggcctgaacaccttcaccaacatggaggcccagctcatccggcagatggagagcgaggggatcttctcccccagcgagctggagatccccaacctggccgagcgcgtgctcgactggctggagaagtacggcgtcgagcggctgaagcgcatggccatctccggggacgactgcgtggtgaagccgatcgacgaccggttcgcgacggccctcaccgccctgaacgacatgggcaaggtccgcaaggacgtgccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactgggtccccacctcccggacgacctggagcatccacgcccaccaccagtggatgaccaccgaggacatgctctccgtgtggaaccgcgtgtggatcgaggagaacccctggatggaggacaagacgcacgtcagctcctggggcgacgtgccgtacctggggaagcgggaggaccagtggtgcggcagcctgatcggcctcaccgcccgcgccacctgggcgtccaacatccaggtggccatcaaccaggtccgccggctgatcgggaacgagaactacctggactgcatgaccagcatgaagcgcttcaagaacgagggcgaccccgagggggccctctggtga

SEQ ID NO: 8729 - RNA, 9879 nt, synthetic construct
  misc_feature 1..9879: note = derived and/or modified CDS sequence (opt1) from DENV-1__EU249495__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccaccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacccgcaccgagacgtggatgagctccgagggcgcctggaagcagatccagcgggtggagacctgggccctccgccaccccgggttcaccgtgatcgccctgttcctggcgcacgccatcggcaccagcatcacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgcggtgctgcggaagctctgcatcgaggccaagatctccaacacgaccaccgacagccgctgccccacccagggcgaggccacgctgatggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgacggtgcacaccggcgaccagcaccaggtcgggaacgagtccaccgagcacggcaccaccgcgacgatcacgccccaggcccccaccagcgagatccagctcaccgactacggggccctgacgctggactgcagcccccggaccggcctcgacttcaacgagatggtgctgctgaccatgaaggagaagtcctggctcgtccacaagcagtggttcctggacctgccgctcccctggacctccggggccagcacgagccaggagacctggaaccggcaggacctgctggtgaccttcaagaccgcccacgcgaagaagcaggaggtggtcgtgctcggctcccaggagggcgccatgcacacggccctgaccggggccaccgagatccagaccagcggcacgaccaccatcttcgccgggcacctgaagtgccgcctcaagatggacaagctgaccctgaagggcatgtcctacgtgatgtgcacggggagcttcaagctcgagaaggaggtcgcggagacccagcacggcaccgtgctggtgcagatcaagtacgagggcaccgacgccccctgcaagatccccttctccacgcaggacgagaagggggtcatccagaacggccggctgatcaccgccaacccgatcgtgaccgacaaggagaagcccgtgaacatcgaggccgagccgcccttcggggagagctacatcgtcatcggcgtgggcgagaaggcgctgaagctctcctggttcaagaaggggagctccatcggcaagatgttcgaggccaccgcccgcggggcccggcgcatggccatcctgggcgacacggcgtgggacttcgggagcatcggcggcgtgttcacctccgtcgggaagctggtgcaccagatcttcggcaccgcctacggggtcctgttcagcggcgtctcctggaccatgaagatcgggatcggcgtgctgctgacgtggctcggcctgaacagccgctccaccagcctgtccatgacctgcatcgccgtggggctcgtcaccctgtacctgggcgtgatggtgcaggccgacagcgggtgcgtcatcaactggaagggccgggagctcaagtgcgggtccggcatcttcgtgacgaacgaggtgcacacctggaccgagcagtacaagttccaggccgacagcccgaagcgcctgagcgcggccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggtgggcatcctcgcccaggggaagaagatgatccggccccagcccatggagcacaagtactcctggaagtcctggggcaaggcgaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggactcctacacccaggcctgcgaccaccgcctcatgagcgcggccatcaaggactccaaggccgtgcacgccgacatgggctactggatcgagagcgagaagaacgagacctggaagctggcccgggcgtccttcatcgaggtcaagacctgcatctggcccaagagccacacgctgtggtccaacggcgtgctcgagagcgagatggtgatccccaagatctacgggggcccgatctcccagcacaactaccgccccgggtacttcacccagaccgccggcccctggcacctggggaagctggagctcgacttcgacctgtgcgagggcaccacggtcgtggtggacgagcactgcggcaaccgggggccgagcctgcgcaccaccaccgtcacgggcaagatcatccacgagtggtgctgccggtcctgcaccctgccgcccctccgcttcaagggggaggacggctgctggtacgggatggagatccggcccgtgaaggagaaggaggagaacctggtcaagagcatggtctccgccggcagcggcgaggtggacagcttctccctcgggctgctgtgcatcagcatcatgatcgaggaggtgatgcgctcccggtggagccgcaagatgctcatgaccggcaccctggccgtcttcctgctcctgatcatggggcagctgacgtggaacgacctcatccggctgtgcatcatggtgggcgccaacgcgtccgaccgcatggggatgggcaccacctacctggccctcatggccaccttcaagatgcgcccgatgttcgccgtggggctgctgttccggcgcctcacgagccgggaggtcctgctgctcaccatcgggctgtccctggtggccagcgtcgagctccccaactccctggaggagctgggcgacgggctcgcgatgggcatcatgatcctgaagctgctcaccgacttccagagccaccagctgtgggccaccctgctctccctgacgttcatcaagaccaccctgagcctccactacgcctggaagaccatggccatggtgctgtccatcgtgagcctgttccccctctgcctgtccacgaccagccagaagaccacctggctgcccgtcctcctgggctccctggggtgcaagccgctcacgatgttcctgatcgcggagaacaagatctggggccgcaagagctggcccctgaacgaggggatcatggccgtgggcgtggtctccatcctcctgagcagcctgctcaagaacgacgtgcccctggccgggcccctgatcgccggcggcatgctcatcgcctgctacgtgatctccgggagctccgcggacctgagcctggagaaggccgccgaggtctcctgggaggaggaggccgagcacagcggcgcctcccacaacatcctcgtggaggtgcaggacgacgggaccatgaagatcaaggacgaggagcgggacgacaccctgaccatcctgctcaaggcgaccctgctggccgtcagcggcgtgtacccgctctccatccccgccacgctgttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacaccatgtggcacgtgacccggggcgccgtgctgatgtaccaggggaagcgcctcgagccctcctgggcgagcgtcaagaaggacctgatctcctacggcggcgggtggcggctgcagggcagctggaacacgggggaggaggtccaggtgatcgccgtcgagcccggcaagaaccccaagaacgtgcagaccgcccccgggaccttcaagacccccgagggcgaggtgggcgccatcgccctcgacttcaagcccgggacgtccggcagccccatcgtcaaccgcgaggggaagatcgtgggcctgtacggcaacggggtggtcaccacctccggcacctacgtgagcgcgatcgcccaggccaaggccagccaggaggggccgctgcccgagatcgaggacgaggtgttccggaagcgcaacctcacgatcatggacctgcaccccggctccgggaagacccggcgctacctgccggcgatcgtccgggaggccatcaagcgcaagctccggaccctgatcctggcccccacccgcgtggtggccagcgagatggccgaggcgctcaagggcatgcccatccgctaccagacgaccgccgtcaagtccgagcacaccggcaaggagatcgtggacctgatgtgccacgccaccttcacgatgcggctgctcagccccgtgcgcgtcccgaactacaacatgatcatcatggacgaggcccacttcaccgacccctccagcatcgccgcgcgggggtacatctccacccgcgtgggcatgggggaggccgccgccatcttcatgaccgccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctgcggaagaacgggaagcgcgtcatccagctgagccggaagaccttcgacacggagtaccagaagaccaagaacaacgactgggactacgtggtgaccaccgacatctccgagatgggcgccaacttccgcgcggaccgggtcatcgacccgcgccggtgcctcaagcccgtgatcctgaaggacgggcccgagcgcgtcatcctggccggccccatgccggtgacggtggccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgagctacaaggtggcctccgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctacagcgaccccctggccctccgggagttcaaggagttcgccgcgggccgccggtccgtgagcggggacctgatcctggagatcggcaagctcccgcagcacctgacccagcgcgcccagaacgccctggacaacctcgtcatgctgcacaactccgagcagggcgggcgggcctaccgccacgcgatggaggagctgcccgacaccatcgagacgctcatgctgctggccctcatcgccgtgctgaccggcggggtgaccctgttcttcctcagcggccgggggctgggcaagacctccatcggcctgctctgcgtcatggccagctccgtgctgctgtggatggccagcgtggagccccactggatcgcggcctccatcatcctcgagttcttcctgatggtcctgctcatccccgagccggaccgccagcggacgccccaggacaaccagctggcctacgtggtgatcgggctcctcttcatgatcctgacggtcgccgccaacgagatgggcctgctcgagaccaccaagaaggacctggggatcggccacgtggcggtggagaaccaccaccacgccaccatgctggacgtcgacctccaccccgccagcgcctggacgctgtacgccgtggcgaccaccatcatcaccccgatgatgcgccacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtcaaccccctgacgctcaccgccgccgtgctgatgctggtggcgcactacgccatcatcggcccggggctccaggccaaggccacccgggaggcccagaagcgcaccgcggccggcatcatgaagaaccccacggtcgacgggatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtgtccatggccaacatcttccgggggagctacctcgccggcgccggcctggcgttctccctgatgaagtccctcgggggcgggcgccggggcaccggggcccagggcgagaccctgggcgagaagtggaagcgccagctgaaccagctcagcaagtccgagttcaacatctacaagcggagcgggatcatggaggtggaccgctccgaggccaaggagggcctgaagcgcggggagacgacccgccacgccgtcagccggggcaccgcgaagctgcgctggttcgtggagcggaacctggtgaagcccgaggggaaggtcatcgacctcggctgcggccgcgggggctggtcctactactgcgccgggctgaagaaggtgaccgaggtgaagggctacacgaagggcgggcccggccacgaggagcccatcccgatggccacctacgggtggaacctggtcaagctccacagcggcaaggacgtgttcttcacgccgcccgagaagtgcgacaccctgctgtgcgacatcggggagtccagccccaacccgacgatcgaggagggccggaccctccgcgtgctgaagatggtcgagccctggctgcgggggaaccagttctgcatcaagatcctcaacccctacatgccctccgtggtggagaccctggagcagatgcagcgcaagcacggcggcatgctggtccggaacccgctcagccgcaactccacccacgagatgtactgggtgagctgcgggaccggcaacatcgtgtccgccgtcaacatgacgagccggatgctgctgaaccgcttcaccatggcccaccgcaagcccacctacgagcgggacgtggacctcggggcgggcacccgccacgtggccgtcgagcccgaggtggccaacctggacatcatcggccagcggatcgagaacatcaagcacgagcacaagtccacgtggcactacgacgaggacaacccctacaagacctgggcctaccacgggagctacgaggtcaagccgtccggcagcgcctccagcatggtgaacggggtggtcaagctgctcaccaagccctgggacgtgatccccatggtgacccagatcgcgatgacggacaccacccccttcggccagcagcgcgtcttcaaggagaaggtggacacccggacgccgaaggccaagcgcgggaccgcccagatcatggaggtgaccgcccggtggctgtggggcttcctgagccgcaacaagaagccccggatctgcacccgcgaggagttcacgcggaaggtccgctccaacgccgcgatcggcgccgtgttcgtggacgagaaccagtggaacagcgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggccctgggcttcatgaacgaggaccactggttcagccgcgagaactccctcagcggggtcgagggcgaggggctgcacaagctgggctacatcctccgggacatctccaagatccccgggggcaacatgtacgcggacgacaccgccggctgggacacccgcatcacggaggacgacctgcagaacgaggccaagatcaccgacatcatggagccggagcacgccctgctcgccaccagcatcttcaagctgacctaccagaacaaggtggtgcgggtccagcgccccgcgaagaacgggacggtgatggacgtgatctcccgccgggaccagcgcggcagcgggcaggtcggcacctacggcctgaacaccttcaccaacatggaggcccagctcatccggcagatggagtccgaggggatcttcctgcccagcgagctggagacgcccaacctcgccgagcgcgtgctggactggctggagaagcacggcgtggagcggctcaagcgcatggccatctccggggacgactgcgtcgtgaagccgatcgacgaccggttcgccaccgcgctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggtccctgcgggagaccgcctgcctcggcaagagctacgcgcagatgtggcagctgatgtacttccaccgccgggacctgcgcctcgccgccaacgccatctgcagcgcggtgcccgtcgactgggtgcccacgtcccggaccacctggagcatccacgcccaccaccagtggatgaccacggaggacatgctgtccgtgtggaaccgcgtctggatcgaggagaacccctggatggaggacaagacccacgtgagctcctggggcgacgtgccgtacctggggaagcgggaggaccagtggtgcggcagcctcatcggcctgaccgcccgcgccacctgggcctccaacatccaggtcgcgatcaaccaggtgcgccggctgatcgggaacgagaactacctcgactacatgaccagcatgaagcgcttcaagaacgagggcgaccccgagggggccctgtggtga

SEQ ID NO: 8730 - RNA, 9879 nt, synthetic construct
  misc_feature 1..9879: note = derived and/or modified CDS sequence (opt1) from DENV-1__EU482794__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtcctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtggggctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgcgtccctgttccccctctgcctgagcacgacctcccagaagaccacctggctgcccgtgctcctgggcagcctggggtgcaagccgctcacgatgttcctgatcaccgagaccaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgtggtgcaggacgacgggaccatgaagatcaaggacgaggagcgggacgacaccctgacgatcctgctcaaggcgaccctgctggccgtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacacgatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagaccgcccccgggacgttcaagacccccgagggcgaggtgggcgccatcgccctcgacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtccgggaggccatcaagcgcaagctccggacgctgatcctggcccccacccgcgtggtggcctccgagatggccgaggcgctcaagggcatgcccatccgctaccagaccaccgccgtcaagagcgagcacacgggcaaggagatcgtggacctgatgtgccacgccaccttcaccatgcggctgctctcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctgtcccggaagaccttcgacaccgagtaccagaagaccaagaacaacgactgggactacgtggtgacgaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaactacaacaaggagggcgaccagtacatctacatggggcagcccctcaacaacgacgaggaccacgcgcactggaccgaggccaagatgctgctggacaacatcaacacgcccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacgcagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgaccggcggggtgaccctgttcttcctctccggccgggggctgggcaagacgagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagaccacgaagaaggacctggggatcggccacgtggcggtggagaaccaccaccacgccaccatgctggacgtcgacctccaccccgcctccgcctggaccctgtacgccgtggcgaccacgatcatcaccccgatgatgcgccacaccatcgagaacaccacggccaacatcagcctgaccgccatcgccaaccaggccgcgatcctcatggggctggacaagggctggcccatctccaagatggacatcggcgtgcccctgctcgccctggggtgctacagccaggtcaaccccctgaccctcaccgccgccgtgctgatgctggtggcgcactacgccatcatcggcccggggctccaggccaaggccacgcgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacctcccagatcctcctgatgcgcacgacctgggccctgtgcgagagcatcaccctcgcgaccggccccctgacgaccctgtgggaggggtccccgggcaagttctggaacaccaccatcgccgtgagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacccgccacgccgtctcccggggcacggcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacctacgggtggaacctggtcaagctccactccggcaaggacgtgttcttcacgccgcccgagaagtgcgacaccctgctgtgcgacatcggggagagctcccccaacccgaccatcgaggagggccggaccctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacgcacgagatgtactgggtgtcctgcgggaccggcaacatcgtgagcgccgtcaacatgacctcccggatgctgctgaaccgcttcaccatggcccaccgcaagcccacgtacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctgctcacgaagccctgggacgtgatccccatggtgacccagatcgcgatgaccgacaccacgcccttcggccagcagcgcgtcttcaaggagaaggtggacacccggaccccgaaggccaagcgcgggaccgcccagatcatggaggtgacggcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacacggccggctgggacacccgcatcaccgaggacgacctgcagaacgaggccaagatcaccgacatcatggagccggagcacgccctgctcgccacgtccatcttcaagctgacctaccagaacaaggtggtgcgggtccagcgccccgcgaagaacgggaccgtgatggacgtgatcagccgccgggaccagcgcggctccgggcaggtcggcacctacggcctgaacacgttcaccaacatggaggcccagctcatccggcagatggagagcgaggggatcttcctgccctccgagctggagacccccaacctcgccgagcgcgtgctggactggctggagaagtacggcgtggagcggctcaagcgcatggccatcagcggggacgactgcgtcgtgaagccgatcgacgaccggttcgccaccgcgctgacggccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggaccacgtggtccatccacgcccaccaccagtggatgaccaccgaggacatgctgagcgtgtggaaccgcgtctggatcgaggagaacccctggatggaggacaagacccacgtgtccagctggggcgacgtgccgtacctggggaagcgggaggaccagtggtgcggctccctcatcggcctgaccgcccgcgccacgtgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8731 - RNA, 9879 nt, synthetic construct
  misc_feature 1..9879: note = derived and/or modified CDS sequence (opt1) from DENV-1__EU482795__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccgcacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttctccgggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctgagctggttcaagaaggggtccagcatcggcaagatgttcgaggccaccgcccgcggggcccggcgcatggccatcctcggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctctccgcggccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggccggcatcctggcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggacagctacacccaggtgtgcgaccaccgcctgatgtccgcggccatcaaggacagcaaggccgtgcacgccgacatgggctactggatcgagtccgagaagaacgagacctggaagctcgcccgggcgagcttcatcgaggtcaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtcgtggacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacgtggaacgacctgatccggctgtgcatcatggtcggcgccaacgcgagcgaccgcatggggatgggcaccacctacctcgccctgatggccaccttcaagatgcgcccgatgttcgccgtgggcctcctgttccggcgcctgacgtcccgggaggtgctgctcctgaccatcgggctgagcctcgtcgcctccgtggagctgcccaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtcctgagcatcgtgtccctgctccccctgtgcctgagcacgacctcccagaagaccacctggctccccgtgctgctgggcagcctcgggtgcaagccgctgacgatgttcctgatcgcggagaacaagatctggggccgcaagagctggcccctcaacgaggggatcatggccgtcggcatcgtgtccatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgccgtcctcatgtaccaggggaagcgcctggagcccagctgggcgtccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagaccagcgagggcgaggtcggcgccatcgccctggacttcaagcccgggacgagcggctcccccatcgtgaaccgcgaggggaagatcgtgggcctgtacggcaacggggtcgtgaccaccagcggcacctacgtgtccgcgatcgcccaggccaaggccagccaggaggggcccctcccggagatcgaggacgaggtcttccggaagcgcaacctgacgatcatggacctgcaccccggctccgggaagacccggcgctacctccccgcgatcgtgcgggaggccatcaagcgcaagctgcggaccctgatcctcgccccgacccgcgtggtcgccagcgagatggccgaggcgctgaagggcatgcccatccgctaccagacgaccgccgtgaagtccgagcacaccggcaaggagatcgtggacctgatgtgccacgccaccttcacgatgcggctcctgagccccgtccgcgtgcccaactacaacatgatcatcatggacgaggcccacttcaccgacccgtccagcatcgccgcgcgggggtacatctccacccgcgtgggcatgggggaggccgccgccatcttcatgaccgccacgccgcccggcagcgtcgaggcgttcccccagtccaacgccgtgatccaggacgaggagcgggacatcccggagcgcagctggaactccgggtacgagtggatcaccgacttccccggcaagaccgtgtggttcgtccccagcatcaagtccggcaacgacatcgccaactgcctgcggaagaacgggaagcgcgtgatccagctcagccggcgcaccttcgacacggagtaccagaagaccaagaacaacgactgggactacgtggtcaccaccgacatctccgagatgggcgccaacttccgggcggaccgcgtgatcgacccccggcgctgcctgaagccggtgatcctgaaggacgggcccgagcgggtcatcctcgccggccccatgcccgtgacggtcgccagcgccgcccagcgccgggggcgcatcggccggaaccacaacaaggagggcgaccagtacatctacatggggcagccgctgaacaacgacgaggaccacgcgcactggaccgaggccaagatgctgctcgacaacatcaacacccccgagggcatcatccccgccctgttcgagcccgagcgcgagaagtccgccgccatcgacggggagtaccgcctgcggggcgaggcgcgcaagaccttcgtggagctcatgcggcgcggggacctgccggtgtggctgtcctacaaggtcgccagcgagggcttccagtactccgaccggcgctggtgcttcgacggcgagcggaacaaccaggtgctcgaggagaacatggacgtggagatctggacgaaggagggggagcgcaagaagctgcggccccgctggctggacgcccggacctacagcgaccccctcgccctgcgcgagttcaaggagttcgccgcgggccggcgctccgtcagcggggacctgatcctcgagatcggcaagctgccccagcacctgacccagcgggcccagaacgccctcgacaacctggtgatgctgcacaactccgagcagggcgggcgcgcctaccggcacgcgatggaggagctcccggacaccatcgagacgctgatgctgctcgccctgatcgccgtgctgaccggcggggtcaccctcttcttcctgagcggccgcgggctgggcaagacctccatcggcctcctgtgcgtgatggccagctccgccctgctctggatggcgagcgtggagccccactggatcgccgcctccatcatcctggagttcttcctgatggtcctcctgatccccgagcccgaccggcagcgcaccccgcaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccgccatgctcgacgtcgacctgcaccccgccagcgcgtggaccctgtacgccgtggccacgaccatcatcacccccatgatgcggcacaccatcgagaacacgaccgccaacatctccctcaccgccatcgcgaaccaggccgccatcctgatggggctggacaagggctggccgatcagcaagatggacatcggcgtgcccctcctggccctggggtgctactcccaggtcaaccccctcaccctgacggcggccgtgctgatgctcgtggcccactacgccatcatcggccccgggctgcaggccaaggcgacccgcgaggcccagaagcgcaccgccgccggcatcatgaagaacccgaccgtcgacgggatcgtggccatcgacctggaccccgtggtctacgacgcgaagttcgagaagcagctcggccagatcatgctgctgatcctctgcacgagccagatcctgctgatgcggaccacctgggccctctgcgagtccatcaccctggccacgggccccctgaccaccctctgggaggggagccccggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggcgaaggagggcctgaagcgcggggagacgaccaagcacgccgtcagccggggcaccgccaagctccgctggttcgtggagcggaacctggtgaagccggaggggaaggtcatcgacctgggctgcggccgcgggggctggtcctactactgcgccgggctgaagaaggtgaccgaggtgaagggctacacgaagggcgggcccggccacgaggagcccatccccatggccacctacgggtggaacctcgtcaagctgcacagcggcaaggacgtgttcttcatcccgcccgagaagtgcgacaccctgctctgcgacatcggggagtccagccccaaccccaccatcgaggagggccggacgctgcgcgtgctgaagatggtcgagccgtggctccgggggaaccagttctgcatcaagatcctgaacccctacatgccctccgtggtggagaccctggagcagatgcagcgcaagcacggcggcatgctcgtccggaaccccctgagccgcaactccacccacgagatgtactgggtgagctgcgggaccggcaacatcgtgtccgcggtcaacatgaccagccggatgctgctcaaccgcttcacgatggcccaccgcaagccgacctacgagcgggacgtggacctgggggccggcacccgccacgtggccgtcgagcccgaggtggccaacctggacatcatcggccagcggatcgagaacatcaagcacgagcacaagtccacctggcactacgacgaggacaacccctacaagacgtgggcgtaccacgggagctacgaggtgaagcccagcggctccgccagctccatggtcaacggggtggtcaagctcctgaccaagccgtgggacgtgatccccatggtgacccagatcgccatgaccgacacgacccccttcggccagcagcgcgtcttcaaggagaaggtggacacccggacccccaaggccaagcgcgggacggcccagatcatggaggtgaccgcgaagtggctgtggggcttcctcagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtcgagggcgaggggctgcacaagctcggctacatcctgcgggacatctccaagatccccgggggcaacatgtacgccgacgacaccgccggctgggacacccgcatcaccgaggacgacctgcagaacgaggccaagatcacggacatcatggagcccgagcacgcgctcctggccaagagcatcttcaagctgacctaccagaacaaggtggtgcgggtccagcgcccggccaagaacgggaccgtgatggacgtgatctcccgccgggaccagcgcggcagcgggcaggtcggcacctacggcctcaacacgttcaccaacatggaggcccagctgatccggcagatggagtccgaggggatcttcagcccctccgagctggagacccccaacctcgccggccgcgtgctggactggctggagaagcacggggtggagcggctcaagcgcatggcgatcagcggcgacgactgcgtcgtgaagcccatcgacgaccggttcgccaccgccctgacggccctgaacgacatggggaaggtgcgcaaggacatcccgcagtgggagcccagcaagggctggaacgactggcagcaggtccccttctgctcccaccacttccaccagctcatcatgaaggacggccgggagatcgtggtgccctgccgcaaccaggacgagctggtcgggcgggcccgcgtgagccagggcgcggggtggtccctgcgggagaccgcctgcctcggcaagagctacgcccagatgtggcagctgatgtacttccaccgccgggacctgcgcctcgccgcgaacgccatctgctccgccgtgccggtcgactgggtgcccaccagccggaccacgtggtccatccacgcccaccaccagtggatgaccaccgaggacatgctgagcgtgtggaaccgcgtctggatcgaggagaacccctggatggaggacaagacccacatctccagctggggcgacgtgccctacctgggcaagcgggaggaccagtggtgcggctccctcatcgggctgacggcccgcgcgacctgggccaccaacatccaggtggccatcaaccaggtccgccggctgatcggcaacgagaactacctcgactacatgaccagcatgaagcgcttcaagaacgagtccgacccggagggggccctgtggtga

SEQ ID NO: 8732 - RNA, 9879 nt, synthetic construct
  misc_feature 1..9879: note = derived and/or modified CDS sequence (opt1) from DENV-1__EU482796__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtcgggctcctgttccggcgcctgacgtcccgggaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtgctcagcatcgtctccctgatccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctggacttcaagcccgggacgagcggctcccccatcgtgaaccgcgaggggaagatcgtgggcctctacggcaacggggtcgtgaccaccagcggcacctacgtgagcgcgatcgcccaggccaaggcctcccaggaggggccgctgcccgagatcgaggacgaggtcttccggaagcgcaacctgacgatcatggacctccaccccggcagcgggaagacccggcgctacctgccggcgatcgtgcgggaggccatcaagcgcaagctgcggaccctcatcctggcccccacccgcgtggtcgcctccgagatggccgaggcgctgaagggcatgcccatccgctaccagacgaccgccgtcaagagcgagcacaccggcaaggagatcgtggacctcatgtgccacgccaccttcacgatgcggctgctgtcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctgaagcccgtgatcctcaaggacgggcccgagcgcgtcatcctggccggccccatgccggtgacggtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccaccatgctggacgtggacctgcaccccgcctccgcctggacgctctacgccgtggcgaccaccatcatcaccccgatgatgcgccacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgggaggcccagaagcgcaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcgcaccacctgggccctgtgcgagagcatcacgctggcgaccggccccctcaccaccctgtgggaggggtccccgggcaagttctggaacacgaccatcgccgtgagcatggccaacatcttccgggggtcctacctggccggcgccggcctcgcgttcagcctgatgaagtccctcgggggcgggcgccgggggaccggggcccagggcgagaccctcggcgagaagtggaagcgccagctgaaccagctgtccaagagcgagttcaacatctacaagcggtccgggatcatggaggtcgaccgcagcgaggccaaggagggcctcaagcgcggggagacgacccgccacgccgtgtcccggggcaccgcgaagctgcgctggttcgtggagcggaacctggtcaagcccgaggggaaggtgatcgacctgggctgcggccgcgggggctggagctactactgcgccgggctcaagaaggtgaccgaggtcaagggctacacgaagggcgggcccggccacgaggagcccatcccgatggccacctacgggtggaacctggtgaagctgcactccggcaaggacgtgttcttcacgccgcccgagaagtgcgacaccctcctgtgcgacatcggggagagctcccccaacccgacgatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggaccggcaacatcgtcagcgccgtgaacatgacgtcccggatgctcctgaaccgcttcaccatggcccaccgcaagcccacctacgagaaggacgtggacctgggggcgggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgccagcagcatggtgaacggggtcgtgaagctgctgaccaagccctgggacgtgatccccatggtcacccagatcgcgatgacggacaccacccccttcggccagcagcgggtgttcaaggagaaggtggacacccgcacgccgaaggccaagcgggggaccgtccagatcatggaggtgaccgcccgctggctctggggcttcctgtcccggaacaagaagccccgcatctgcacccgggaggagttcacgcgcaaggtgcggagcaacgccgccatcggcgcggtcttcgtggacgagaaccagtggaactccgccaaggaggccgtggaggacgagcgcttctgggacctggtcaagaaggagcgggagctccacaagcaggggaagtgcgcgacctgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgcgggctgggacacccggatcacggaggacgacctccagaacgaggccaagatcaccgacatcatggagccggagcacgccctgctggccacctccatcttcaagctcacctaccagaacaaggtcgtgcgcgtgcagcggcccgccaagaacgggacggtcatggacgtgatcagccgccgcgaccagcggggctccggccaggtgggcacctacggcctgaacaccttcaccaacatggaggcgcagctgatccgccagatggagagcgaggggatcttcctcccctccgagctggagacgcccaacctggccgagcgggtcctcgactggctggagaagtacggcgtggagcgcctgaagcggatggccatcagcggggacgactgcgtggtcaagccgatcgacgaccgcttcgccaccgccctcaccgcgctgaacgacatgggcaaggtgcggaaggacatcccccagtgggagccctccaaggggtggaacgactggcagcaggtccccttctgcagccaccacttccaccagctgatcatgaaggacggccgcgagatcgtcgtgccgtgccggaaccaggacgagctcgtgggccgcgcccgggtctcccagggggccggctggagcctgcgcgagaccgcctgcctgggcaagagctacgcccagatgtggcagctcatgtacttccaccggcgcgacctgcggctggcggccaacgccatctgctccgccgtgcccgtggactgggtccccacgagccgcaccacctggtccatccacgcgcaccaccagtggatgaccacggaggacatgctcagcgtgtggaaccgggtgtggatcgaggagaacccctggatggaggacaagacccacgtctccagctggggcgacgtgccgtacctggggaagcgcgaggaccagtggtgcggctccctgatcggcctcaccgcccgggccacctgggccagcaacatccaggtggccatcaaccaggtccgccgcctgatcgggaacgagaactacctggactacatgacctccatgaagcggttcaagaacgagggcgaccccgagggggcgctctggtga

SEQ ID NO: 8733 - RNA, 9879 nt, synthetic construct
  misc_feature 1..9879: note = derived and/or modified CDS sequence (opt1) from DENV-1__EU482797__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccaccgccctcacggccctgaacgacatggggaaggtccggaaggacgtgccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagaccgcctgcctgggcaagtcctacgcccagatgtggcagctcatgtacttccaccggcgcgacctgcggctggccgcgaacgccatctgcagcgccgtgccggtggactgggtccccacctcccgcaccacgtggagcatccacgcccaccaccagtggatgaccaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcacggcccgggcgacctgggccaccaacatccaggtggccatcaaccaggtgcgccgcctgatcggcaacgagaactacctggactacatgacctccatgaagcggttcaagaacgagagcgacccggagggggccctctggtga

SEQ ID NO: 8734 - RNA, 9879 nt, synthetic construct
  misc_feature 1..9879: note = derived and/or modified CDS sequence (opt1) from DENV-1__EU482799__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgtgatcggcaccagcatcacccagaaggggatcatcttcatcctcctgatgctggtcacgccctccatggcgatgcggtgcgtgggcatcggcagccgcgacttcgtggaggggctctccggcgccacctgggtcgacgtggtgctggagcacgggagctgcgtcaccaccatggccaaggacaagcccacgctggacatcgagctcctgaagaccgaggtgaccaaccccgccgtgctgcggaagctctgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacacgggcgaccagcaccaggtcgggaacgagtccaccgagcacggcaccaccgccaccatcacgccccaggcccccaccaccgagatccagctcaccgactacggggcgctgacgctggactgcagcccccgcaccggcctcgacttcaacgagatggtgctgctgaccatgaaggagaagtcctggctcgtgcacaagcagtggttcctggacctgcccctcccctggaccagcggggccagcacgtcccaggagacctggaaccggcaggacctgctggtcaccttcaagaccgcccacgccaagaagcaggaggtggtggtcctcggcagccaggagggcgccatgcacacggcgctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcatcatcggcgccggcgagaagacgctgaagctcagctggttcaagaaggggtccagcatcggcaagatgttcgaggccaccgcgcgcggggcccggcgcatggccatcctgggcgacaccgcctgggacttcgggtccatcggcggcgtgttcaccagcgtcgggaagctggtgcaccagatcttcggcacggcctacggggtgctgttctccggcgtcagctggaccatgaagatcgggatcggcgtgctgctgacctggctcggcctgaactcccgcagcacctccctgagcatgacgtgcatcgcggtggggctcgtcaccctgtacctgggcgtgatggtgcaggccgactccgggtgcgtcatcaactggaagggccgggagctcaagtgcgggagcggcatcttcgtgaccaacgagatccacacctggaccgagcagtacaagttccaggccgacagcccgaagcgcctgtccgccgccatcggcaaggcgtgggaggagggggtgtgcggcatccggagcgccacgcgcctggagaacatcatgtggaagcagatctccaacgagctcaaccacatcctgctggagaacgacatgaagttcaccgtcgtggtgggggacgtcgccggcatcctcgcccaggggaagaagatgatccggccccagcccatggagtacaagtacagctggaagtcctggggcaaggccaagatcatcggcgcggacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggacagctacacccaggtctgcgaccaccgcctcatgtccgccgccatcaaggacagcaaggcggtgcacgccgacatgggctactggatcgagtccgagaagaacgagacgtggaagctggcccgggccagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtggtcgacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgcgggcagcggcgaggtggactccttcagcctcgggctgctgtgcatctccatcatgatcgaggaggtcatgcggagccgctggtcccggaagatgctcatgacgggcaccctggccgtgttcttcctgctcatcatggggcagctgacctggaacgacctgatccgcctctgcatcatggtgggcgccaacgccagcgaccgcatggggatgggcaccacgtacctggccctgatggcgaccttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggccatgggcatcatgatcctcaagctgctgacggacttccagtcccaccagctctgggccaccctgctgagcctcaccttcatcaagaccacgttctccctgcactacgcgtggaagaccatggccatggtgctgagcatcgtctccctcttccccctgtgcctgagcaccacctcccagaagacgacctggctccccgtgctgctgggcagcctcgggtgcaagccgctgaccatgttcctgatcgccgagaacaagatctggggccggcgctcctggcccctcaacgaggggatcatggccgtgggcatcgtcagcatcctgctgagctccctcctgaagaacgacgtgcccctggcggggcccctcatcgccggcggcatgctgatcgcctgctacgtgatcagcgggtccagcgccgacctgtccctcgagaaggccgcggaggtcagctgggaggaggaggccgagcactccggcgccagccacaacatcctggtggaggtgcaggacgacgggaccatgaagatcaaggacgaggagcgggacgacaccctgacgatcctcctgaaggccaccctgctcgccgtctccggcgtgtacccgctgagcatccccgcgaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacacgatgtggcacgtgacccggggcgccgtgctcatgtaccaggggaagcgcctggagcccagctgggcctccgtcaagaaggacctgatcagctacggcggcgggtggcggctccagggctcctggaacaccggggaggaggtccaggtgatcgccgtcgagcccggcaagaaccccaagaacgtgcagaccgcgcccgggacgttcaagacccccgagggcgaggtgggcgccatcgccctggacttcaagcccgggaccagcggctcccccatcgtcaaccgcgaggggaagatcgtgggcctgtacggcaacggggtggtcaccacgagcggcacctacgtgagcgccatcgcccaggcgaaggcctcccaggaggggccgctccccgagatcgaggacgaggtgttccggaagcgcaacctgaccatcatggacctgcaccccggcagcgggaagacccggcgctacctcccggccatcgtccgggaggccatcaagcgcaagctgcgcacgctgatcctcgcgcccacccgggtggtggcctccgagatggccgaggccctgaagggcatgcccatccgctaccagaccaccgccgtcaagagcgagcacacgggcaaggagatcgtggacctgatgtgccacgcgaccttcaccatgcggctcctgtcccccgtgcgcgtcccgaactacaacatgatcatcatggacgaggcccacttcaccgaccccagctccatcgccgcccgggggtacatcagcacgcgcgtgggcatgggggaggccgcggccatcttcatgaccgccacgccgcccggctccgtggaggccttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgcgaactgcctgcggaagaacgggaagcgcgtcatccagctctcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctgaaggacgggcccgagcgcgtgatcctcgccggccccatgccggtcaccgtggcgtccgccgcccagcggcgcgggcggatcggccgcaaccacaacaaggagggcgaccagtacatctacatggggcagcccctgaacaacgacgaggaccacgcccactggaccgaggccaagatgctgctcgacaacatcaacacgcccgagggcatcatccccgcgctgttcgagccggagcgcgagaagtccgccgccatcgacggggagtaccggctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcgcgcacctactccgaccccctcgccctgcgggagttcaaggagttcgccgccggccgccggagcgtgtccggggacctgatcctcgagatcggcaagctgccgcagcacctgacgcagcgcgcccagaacgcgctcgacaacctggtcatgctgcacaacagcgagcagggcgggcgggcctaccgccacgccatggaggagctccccgacaccatcgagaccctgatgctgctcgccctgatcgcggtgctgaccggcggggtgaccctcttcttcctgtccggccgggggctgggcaagacgagcatcggcctcctgtgcgtcatggcctccagcgtgctgctctggatggcctccgtggagccccactggatcgccgccagcatcatcctggagttcttcctgatggtcctcctgatccccgagccggaccgccagcggacgccccaggacaaccagctggcgtacgtggtgatcgggctcctgttcatgatcctgaccgtcgccgccaacgagatgggcctcctggagaccacgaagaaggacctggggatcggccacgtggccgtggagaaccaccaccacgccgcgatgctcgacgtcgacctgcaccccgcctccgcctggaccctgtacgccgtggccaccaccatcatcacgccgatgatgcgccacaccatcgagaacaccaccgcgaacatcagcctcacggccatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgcgatcatcggcccggggctgcaggccaaggccacccgcgaggcccagaagcggacggccgcgggcatcatgaagaaccccaccgtcgacgggatcgtggccatcgacctggaccccgtggtctacgacgccaagttcgagaagcagctcggccagatcatgctgctgatcctctgcacctcccagatcctgctgatgcgcaccacgtgggccctctgcgagagcatcaccctggccaccggccccctgaccacgctctgggaggggtccccgggcaagttctggaacaccaccatcgcggtgagcatggccaacatcttccgggggtcctacctggccggcgccggcctggccttcagcctcatgaagtccctcgggggcgggcgccgggggaccggggcgcagggcgagacgctgggcgagaagtggaagcgccagctcaaccagctgtccaagagcgagttcaacacctacaagcggtccgggatcatggaggtggaccgcagcgaggccaaggagggcctgaagcgcggggagaccaccaagcacgccgtctcccgcggcacggccaagctccggtggttcgtggagcgcaacctggtgaagcccgaggggaaggtcatcgacctgggctgcggccgcgggggctggagctactactgcgcggggctgaagaaggtgaccgaggtgaagggctacaccaagggcggccccggccacgaggagcccatcccgatggccacctacgggtggaacctcgtcaagctgcactccggcaaggacgtgttcttcatcccgcccgagaagtgcgacacgctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggacgggcaacatcgtgagcgccgtcaacatgacctcccgcatgctgctcaaccgcttcaccatggcccaccggaagcccacctacgagcgcgacgtggacctgggggccggcacgcggcacgtggcggtcgagcccgaggtggccaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgaccaagccctgggacgtgatccccatggtgacgcagatcgccatgaccgacaccacccccttcggccagcagcgggtcttcaaggagaaggtggacacgcgcaccccgaaggcgaagcgggggaccgcccagatcatggaggtgaccgccaagtggctgtggggcttcctctcccgcaacaagaagccccggatctgcacgcgcgaggagttcacccggaaggtccgcagcaacgccgccatcggcgcggtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggcgaaggggagccgggccatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgcgggctgggacacgcggatcaccgaggacgacctgcagaacgaggcccgcatcaccgacatcatggagccggagcacgccctcctggccaagtccatcttcaagctgacctaccagaacaaggtggtgcgcgtccagcggcccgccaagaacgggacggtgatggacgtgatcagccgccgggaccagcgcggctccgggcaggtcggcacctacggcctcaacaccttcaccaacatggaggcgcagctgatccggcagatggagagcgaggggatcttctcccccagcgagctggagacgcccaacctcgccgagcgcgtgctggactggctggagaagtacggcgtggagcggctcaagcgcatggccatctccggggacgactgcgtcgtgaagccgatcgacgaccggttcgccaccgccctgaccgcgctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcctgcctcgggaagtcctacgcccagatgtggcagctgatgtacttccaccgccgggacctgcgcctcgcggccaacgccatctgcagcgccgtgcccgtcgactggatccccacgtcccggaccacctggagcatccacgcgcaccaccagtggatgaccacggaggacatgctgtccgtgtggaaccgcgtgtggatcgaggagaacccctggatggaggacaagacccacatcagctcctggggcgacgtcccgtacctggggaagcgcgaggaccagtggtgcggcagcctcatcggcctgaccgcccgggccacctgggccaccaacatccaggtggccatcaaccaggtgcgccggctgatcgggaacgagaactacctcgactacatgacgtccatgaagcgcttcaagaacgagagcgaccccgagggcgcgctgtggtga

SEQ ID NO: 8735 - RNA, 9879 nt, synthetic construct
  misc_feature 1..9879: note = derived and/or modified CDS sequence (opt1) from DENV-1__EU482800__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggccagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccatcgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagaccgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgtgacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgccaacgcgtccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggccagcgtcgagctgcccaactccctggaggagctcggcgacgggctggcgatgggcatcatgatcctgaagctcctgaccgacttccagagccaccagctgtgggccaccctcctgtccctgaccttcatcaagacgaccttcagcctccactacgcctggaagaccatggccatggtgctgtccatcgtgagcctgttccccctctgcctgtccaccacgagccagaagaccacctggctgcccgtcctcctgggctccctggggtgcaagccgctcaccatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggacgatgaagatcaaggacgaggagcgggacgacaccctgaccatcctgctcaaggcgaccctgctggccgtgagcggcgtctacccgctctccatccccgccaccctgttcgtgtggtacttctggcagaagaagaagcagcgcagcggggtgctgtgggacacgcccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgccgtgctgatgtaccaggggaagcgcctcgagccctcctgggcgagcgtgaagaaggacctgatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgccctcgacttcaagcccgggaccagcggcagccccatcgtgaaccgcgaggggaagatcgtcggcctgtacggcaacggggtggtgacgacctccggcacctacgtcagcgcgatcgcccaggccaaggcctcccaggaggggcccctgccggagatcgaggacgaggtgttccggaagcgcaacctcaccatcatggacctgcaccccggcagcgggaagacgcggcgctacctgcccgcgatcgtgcgggaggccatcaagcgcaagctccggaccctgatcctggccccgacccgcgtcgtggcctccgagatggccgaggcgctcaagggcatgcccatccgctaccagaccacggccgtcaagagcgagcacaccggcaaggagatcgtcgacctgatgtgccacgccaccttcaccatgcggctgctctcccccgtgcgcgtgcccaactacaacatgatcatcatggacgaggcccacttcacggacccgagctccatcgccgcgcgggggtacatcagcacccgcgtcggcatgggggaggccgccgccatcttcatgaccgccacgccgcccggctccgtggaggcgttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctgcggaagaacgggaagcgcgtgatccagctgtcccggaagaccttcgacaccgagtaccagaagacgaagaacaacgactgggactacgtcgtgaccaccgacatcagcgagatgggcgccaacttccgcgcggaccgggtgatcgacccccgccggtgcctcaagccggtcatcctgaaggacgggcccgagcgcgtgatcctggccggccccatgcccgtcaccgtggcctccgccgcccagcggcgcgggcggatcggccgcaaccacaacaaggagggcgaccagtacatctacatggggcagccgctcaacaacgacgaggaccacgcgcactggacggaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagaccctcatgctgctggccctcatcgccgtcctgacgggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagcccgaccgccagcggaccccgcaggacaaccagctggcctacgtcgtgatcgggctcctcttcatgatcctgaccgtggccgccaacgagatgggcctgctcgagacgaccaagaaggacctggggatcggccacgtcgcggtggagaaccaccaccacgccgccatgctggacgtggacctccaccccgcctccgcctggaccctgtacgcggtcgccaccacgatcatcacccccatgatgcgccacaccatcgagaacaccacggccaacatcagcctgaccgccatcgccaaccaggcggccatcctcatggggctggacaagggctggccgatctccaagatggacatcggcgtgcccctgctcgccctggggtgctacagccaggtgaaccccctgaccctcaccgccgcggtcctgatgctggtggcccactacgccatcatcggccccgggctccaggccaaggccacgcgggaggcgcagaagcgcaccgccgccggcatcatgaagaacccgaccgtggacgggatcgtcgccatcgacctggaccccgtggtgtacgacgccaagttcgagaagcagctgggccagatcatgctcctgatcctgtgcacctcccagatcctcctgatgcgcacgacctgggcgctgtgcgagagcatcaccctcgccaccggccccctgacgaccctgtgggaggggtcccccggcaagttctggaacaccaccatcgccgtcagcatggccaacatcttccgggggagctacctcgccggcgcgggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgcggtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgccgtgaacatgacctcccgcatgctgctgaaccggttcaccatggtccaccgcaagccgacgtacgagcgcgacgtggacctcggggcgggcacccggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtcaagcccagcggcagcgcctccagcatggtgaacggggtggtcaagctgctcacgaagccgtgggacgtgatccccatggtgacccagatcgcgatgaccgacaccacgcccttcggccagcagcgggtcttcaaggagaaggtggacacccgcacccccaaggccaagcgggggaccgcccagatcatggaggtgacggccaagtggctgtggggcttcctgtcccgcaacaagaagccgcggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgcggacgacacggccggctgggacacccggatcaccgaggacgacctgcagaacgaggccaagatcaccgacatcatggagcccgagcacgccctgctcgccaagtccatcttcaagctgacgtaccagaacaaggtggtgcgcgtccagcggccggcgaagaacgggaccgtgatggacgtgatcagccgccgcgaccagcggggctccgggcaggtcggcacctacggcctgaacaccttcacgaacatggaggcccagctcatccgccagatggagagcgaggggatcttctcccccagcgagctggagacccccaacctggccggccgggtgttcgactggctcgagaagcacggggtggagcgcctgaagcggatggccatctccggcgacgactgcgtcgtgaagcccatcgacgaccgcttcgccaccgcgctgaccgccctcaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctggtcgggcgcgcccgggtgtcccagggcgccgggtggagcctccgcgagacggcctgcctgggcaagtcctacgcgcagatgtggcagctgatgtacttccaccggcgcgacctccggctggccgccaacgccatctgcagcgcggtgccggtcgactgggtgcccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccctacctcggcaagcgcgaggaccagtggtgcggcagcctgatcgggctgaccgcccgggccacgtgggccaccaacatccaggtggcgatcaaccaggtccgccgcctcatcggcaacgagaactacctggactacatgacctccatgaagcggttcaagaacgagagcgacccggagggggccctgtggtga

SEQ ID NO: 8736 - RNA, 9879 nt, synthetic construct
  misc_feature 1..9879: note = derived and/or modified CDS sequence (opt1) from DENV-1__EU482801__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaacatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctcaacaccttcaccaacatggaggcccagctgatccggcagatggagagcgagggcatcttctcccccagcgagctggagacccccaacctcgccgagcgcgtgctggactggctggagaagtacggggtcgagcggctcaagcgcatggccatctccggcgacgactgcgtggtgaagccgatcgacgaccggttcgcgacggccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcgtgcctcggcaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgcgaggaccagtggtgcggcagcctcatcgggctgaccgcccgggccacctgggcgaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8737 - RNA, 9879 nt, synthetic construct
  misc_feature 1..9879: note = derived and/or modified CDS sequence (opt1) from DENV-1__EU482802__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccgcacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgctccccctgtgcctgtccacgaccagccagaagaccacctggctccccgtgctgctgggctccctcgggtgcaagccgctgacgatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgggacgacaccctgaccatcctcctgaaggccaccctgctcgccgtgagcggcgtgtacccgctgtccatccccgccacgctgttcgtctggtacttctggcagaagaagaagcagcgcagcggggtgctctgggacacccccagcccgcccgaggtggagcgggccgtcctggacgacggcatctaccgcatcatgcagcggggcctgctggggcgcagccaggtgggcgtgggggtcttccaggagaacgtgttccacaccatgtggcacgtgacccggggcgcggtcctcatgtaccaggggaagcgcctggagccctcctgggccagcgtgaagaaggacctgatctcctacggcggcgggtggcggctccagggcagctggaacacgggggaggaggtgcaggtcatcgccgtggagcccggcaagaaccccaagaacgtgcagaccgcccccgggaccttcaagacctccgagggcgaggtcggcgccatcgcgctggacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctcccggagatcgaggacgaggtcttccggaagcgcaacctgacgatcatggacctgcaccccggcagcgggaagacccggcgctacctccccgccatcgtgcgggaggccatcaagcgcaagctgcggaccctgatcctcgccccgacccgcgtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggcgcaccttcgacacggagtaccagaagaccaagaacaacgactgggactacgtggtcaccaccgacatcagcgagatgggcgcgaacttccgggccgaccgcgtgatcgacccccggcgctgcctgaagccggtgatcctgaaggacgggcccgagcgggtcatcctcgccggccccatgcccgtgacggtcgcctccgccgcgcagcgccgggggcgcatcggccggaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtggagctcatgcggcgcggggacctgccggtgtggctgagctacaaggtcgcctccgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccccagcacctgacccagcgggcccagaacgccctcgacaacctggtgatgctgcacaacagcgagcagggcgggcgcgcgtaccggcacgccatggaggagctcccggacaccatcgagacgctgatgctgctcgccctgatcgccgtgctgaccggcggggtcaccctcttcttcctgtccggccgcgggctgggcaagaccagcatcggcctcctgtgcgtgatggcctccagcgcgctgctctggatggcctccgtggagccccactggatcgccgccagcatcatcctggagttcttcctgatggtcctcctgatccccgagcccgaccggcagcgcaccccgcaggacaaccagctggcctacgtggtgatcgggctcctgttcatgatcctgacggtcgcggccaacgagatgggcctcctggagaccaccaagaaggacctggggatcggccacgtggccgtggagaaccaccaccacgccgccatgctcgacgtcgacctgcaccccgcgtccgcctggaccctgtacgccgtggccacgaccatcatcacccccatgatgcggcacaccatcgagaacacgaccgccaacatcagcctcaccgcgatcgccaaccaggccgccatcctgatggggctggacaagggctggccgatctccaagatggacatcggcgtgcccctcctggcgctggggtgctacagccaggtcaaccccctcaccctgacggccgccgtgctgatgctcgtggcccactacgccatcatcggccccgggctgcaggcgaaggccacccgcgaggcccagaagcgcaccgccgccggcatcatgaagaacccgaccgtcgacgggatcgtggcgatcgacctggaccccgtggtctacgacgccaagttcgagaagcagctcggccagatcatgctgctgatcctctgcacgtcccagatcctgctgatgcggaccacctgggccctctgcgagagcatcaccctggccacgggccccctgaccaccctctgggaggggtcccccggcaagttctggaacaccacgatcgccgtgagcatggcgaacatcttccgcgggagctacctggccggcgccggcctggccttctccctcatgaagtccctcgggggcgggcggcgcgggaccggggcgcagggcgagaccctgggcgagaagtggaagcggcagctcaaccagctgtccaagagcgagttcaacacctacaagcgctccgggatcatggaggtggaccggagcgaggccaaggagggcctgaagcgcggggagacgaccaagcacgccgtctcccggggcaccgccaagctccgctggttcgtggagcggaacctggtgaagccggaggggaaggtcatcgacctgggctgcggccgcgggggctggagctactactgcgccgggctgaagaaggtgaccgaggtgaagggctacacgaagggcgggcccggccacgaggagcccatccccatggcgacctacgggtggaacctcgtcaagctgcactccggcaaggacgtgttcttcatcccgcccgagaagtgcgacaccctgctctgcgacatcggggagagctcccccaaccccaccatcgaggagggccggacgctgcgcgtgctgaagatggtcgagccgtggctccgggggaaccagttctgcatcaagatcctgaacccctacatgcccagcgtggtggagaccctggagcagatgcagcgcaagcacggcggcatgctcgtccggaaccccctgtcccgcaacagcacccacgagatgtactgggtgtcctgcgggaccggcaacatcgtgagcgccgtcaacatgacctcccggatgctgctcaaccgcttcacgatggcccaccgcaagccgacctacgagcgggacgtggacctgggggccggcacccgccacgtggccgtcgagcccgaggtggcgaacctggacatcatcggccagcggatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctcctgaccaagccgtgggacgtgatccccatggtgacccagatcgccatgaccgacacgacccccttcggccagcagcgcgtcttcaaggagaaggtggacacccggacccccaagtccaagcgcgggacggcccagatcatggaggtgaccgcgaagtggctgtggggcttcctcagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtcgagggcgaggggctgcacaagctcggctacatcctgcgggacatctccaagatccccgggggcaacatgtacgccgacgacaccgccggctgggacacccgcatcaccgaggacgacctgcagaacgaggccaagatcacggacatcatggagcccgagcacgcgctcctggccaagagcatcttcaagctgacctaccagaacaaggtggtgcgggtccagcgcccggccaagaacgggaccgtgatggacgtgatctcccgccgggaccagcgcggcagcgggcaggtcggcacctacggcctcaacacgttcaccaacatggaggcccagctgatccggcagatggagtccgaggggatcttcagcccctccgagctggagacccccaacctcgccggccgcgtgctggactggctggagaagcacggggtggagcggctcaagcgcatggcgatcagcggcgacgactgcgtcgtgaagcccatcgacgaccggttcgccaccgccctgacggccctgaacgacatggggaaggtgcgcaaggacatcccgcagtgggagcccagcaagggctggaacgactggcagcaggtccccttctgctcccaccacttccaccagctcatcatgaaggacggccgggagatcgtggtgccctgccgcaaccaggacgagctggtcgggcgggcccgcgtgagccagggcgcggggtggtccctgcgggagaccgcctgcctcggcaagagctacgcccagatgtggcagctgatgtacttccaccgccgggacctgcgcctcgccgcgaacgccatctgctccgccgtgccggtcgactgggtgcccaccagccggaccacgtggtccatccacgcccaccaccagtggatgaccaccgaggacatgctgagcgtgtggaaccgcgtctggatcgaggagaacccctggatggaggacaagacccacatctccagctggggcgacgtgccctacctgggcaagcgggaggaccagtggtgcggctccctcatcgggctgacggcccgcgcgacctgggccaccaacatccaggtggccatcaaccaggtccgccggctgatcggcaacgagaactacctcgactacatgaccagcatgaagcgcttcaagaacgagtccgacccggagggggccctgtggtga

SEQ ID NO: 8738 - RNA, 9879 nt, synthetic construct
  misc_feature 1..9879: note = derived and/or modified CDS sequence (opt1) from DENV-1__EU482804__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaaggtcgtgcagtacgagaacctgaagtacagcgtgatcgtcaccgtgcacaccggcgaccagcaccaggtcgggaacgagtccacggagcacggcaccaccgcgaccatcacgccccaggcccccagcacggagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggaccagcggggcctccaccagccaggagacctggaaccggaaggacctcctggtcacgttcaagaccgcccacgcgaagaagcaggaggtggtggtcctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggcggagacccagcacggcacggtcctcgtgcagatcaagtacgagggcaccgacgccccctgcaagatccccttctccacccaggacgagaagggggtgacccagaacggccggctgatcacggccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtcttcacgtccgtggggaagctggtgcaccagatcttcggcaccgcctacggggtcctgttcagcggcgtgtcctggaccatgaagatcgggatcggcgtgctcctgacctggctgggcctcaacagccgctccacgagcctgtccatgacctgcatcgccgtcgggctggtgaccctctacctgggcgtgatggtccaggccgacagcgggtgcgtgatcaactggaagggccgggagctgaagtgcgggagcggcatcttcgtgaccaacgaggtccacacgtggaccgagcagtacaagttccaggcggactccccgaagcgcctcagcgccgccatcggcaaggcctgggaggagggggtgtgcggcatccggtccaccacccgcctggagaacatcatgtggaagcagatcagcaacgagctgaaccacatcctcctggagaacgacatgaagttcaccgtggtcgtgggggacgtggccggcatcctggcgcaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcacggggcagctcacctggaacgacctgatccggctgtgcatcatggtgggcgccaacgcgtccgaccgcatggggatgggcaccacctacctcgccctgatggccacgttcaagatgcgcccgatgttcgccgtggggctcctgttccggcgcctgaccagccgggaggtcctgctcctgaccatcgggctgtccctcgtggccagcgtcgagctgcccaactccctggaggagctcggcgacgggctggcgatgggcatcatgatcctgaagctcctgaccgacttccagagccaccagctgtgggccacgctcctgtccctgaccttcatcaagaccaccttcagcctccactacgcctggaagacgatggccatggtgctgtccatcgtgagcctgttccccctctgcctgtccaccaccagccagaagaccacgtggctgcccgtcctcctgggctccctggggtgcaagccgctcaccatgttcctgatcgcggagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgacgctgctggccgtgagcggcgtctacccgctctccatccccgccaccctgttcgtgtggtacttctggcagaagaagaagcagcgcagcggggtgctgtgggacacccccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacgcggggcgccgtgctgatgtaccaggggaagcgcctcgagccctcctgggcgagcgtgaagaaggacctgatctcctacggcggcgggtggcggctgcagggcagctggaacaccggggaggaggtccaggtgatcgccgtggagcccggcaagaaccccaagaacgtccagaccgcccccgggaccttcaagacgtccgagggcgaggtgggcgccatcgccctcgacttcaagcccgggaccagcggcagccccatcgtgaaccgcgaggggaagatcgtcggcctgtacggcaacggggtggtgaccacctccggcacgtacgtcagcgcgatcgcccaggccaaggcctcccaggaggggcccctgccggagatcgaggacgaggtgttccggaagcgcaacctcaccatcatggacctgcaccccggcagcgggaagacccggcgctacctgcccgcgatcgtgcgggaggccatcaagcgcaagctccggaccctgatcctggccccgacgcgcgtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgcccaactacaacatgatcatcatggacgaggcccacttcaccgacccgagctccatcgccgcgcgggggtacatcagcacccgcgtcggcatgggggaggccgccgccatcttcatgacggccacgccgcccggctccgtggaggcgttcccccagagcaacgccgtgatccaggacgaggagcgggacatcccggagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccccgccggtgcctcaagccggtcatcctgaaggacgggcccgagcgcgtgatcctggccggccccatgcccgtcaccgtggcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagacgttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacacgatcgagaccctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagcccgaccgccagcggacgccgcaggacaaccagctggcctacgtcgtgatcgggctcctcttcatgatcctgaccgtggccgccaacgagatgggcctgctcgagaccaccaagaaggacctggggatcggccacgtcgcggccgagaaccaccaccacgccgccatgctggacgtggacctccaccccgcctccgcgtggacgctgtacgccgtggccaccaccatcatcacccccatgatgcgccacacgatcgagaacaccaccgccaacatcagcctgaccgccatcgcgaaccaggccgccatcctcatggggctggacaagggctggccgatctccaagatggacatcggcgtccccctgctcgccctggggtgctacagccaggtgaaccccctgacgctcaccgcggccgtgctgatgctggtcgcccactacgccatcatcggccccgggctccaggccaaggcgacccgggaggcccagaagcgcaccgccgccggcatcatgaagaacccgacggtggacgggatcgtggccatcgacctggaccccgtcgtgtacgacgcgaagttcgagaagcagctgggccagatcatgctcctgatcctgtgcacctcccagatcctcctgatgcgcaccacctgggccctgtgcgagagcatcacgctcgccaccggccccctgaccaccctgtgggaggggtcccccggcaagttctggaacacgaccatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacgtacaagcggtccgggatcatggaggtcgaccgcagcgaggcgaaggagggcctgaagcgcggggagaccaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacgtcccgcatgctgctgaaccggttcaccatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctgtcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8739 - RNA, 9879 nt, synthetic construct
  misc_feature 1..9879: note = derived and/or modified CDS sequence (opt1) from DENV-1__EU482806__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtgggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgcctccgcctggacgctgtacgccgtcgcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgccgtgaacatgacgtcccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgtcccgcaacaagaagccccggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtcgtgcgggtgcagcgccccgcgaagaacgggacggtcatggacgtgatcagccgccgggaccagcgcggctccggccaggtgggcacctacggcctgaacaccttcaccaacatggaggcccagctcatccggcagatggagagcgaggggatcttctccccctgcgagctggagatccccaacctggccgagcgcgtcctcgactggctggagaagtacggcgtggagcggctgaagcgcatggccatcagcggggacgactgcgtggtcaagccgatcgacgaccggttcgccacggcgctcaccgccctgaacgacatgggcaaggtgcgcaaggacgtgccccagtgggagccctccaaggggtggaacgactggcagcaggtccccttctgcagccaccacttccaccagctgatcatgaaggacggccgggagatcgtggtgccgtgccgcaaccaggacgagctcgtcggccgggcccgcgtgtcccagggggccggctggagcctgcgggagaccgcctgcctgggcaagagctacgcgcagatgtggcagctcatgtacttccaccgccgggacctgcgcctggccgccaacgccatctgctccgcggtgcccgtcgactgggtgcccaccagccggacgacctggtccatccacgcccaccaccagtggatgaccaccgaggacatgctcagcgtgtggaaccgcgtctggatcgaggagaacccctggatggaggacaagacgcacgtgtccagctggggcgacgtgccgtacctggggaagcgggaggaccagtggtgcggctccctgatcggcctcaccgcccgcgccacctgggccagcaacatccaggtcgcgatcaaccaggtgcgccggctgatcgggaacgagaactacctggactacatgacctccatgaagcgcttcaagaacgagggcgaccccgagggggccctctggtga

SEQ ID NO: 8740 - RNA, 9879 nt, synthetic construct
  misc_feature 1..9879: note = derived and/or modified CDS sequence (opt1) from DENV-1__EU482807__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgcgggggtgaacatgtgcaccctcgtggccatggacctgggggagttctgcgaggacacgatgacctacaagtgcccccgcatcaccgaggccgagcccgacgacgtggactgctggtgcaacgccaccgacacgtgggtgacctacgggacctgcagccagaccggggagcaccggcgcgacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtcaccccctccatggccatgcggtgcgtgggcatcggcagccgcgacttcgtggaggggctgtccggcgccacgtgggtcgacgtggtgctcgagcacgggagctgcgtcaccaccatggccaaggacaagcccaccctggacatcgagctgctcaagacggaggtgaccaaccccgcggtgctgcggaagctgtgcatcgaggccaagatctccaacaccaccacggacagccgctgcccgacccagggcgaggccaccctcgtcgaggagcaggacgccaacttcgtgtgccggcgcaccttcgtggaccggggctgggggaacggctgcgggctgttcggcaaggggtccctgatcacgtgcgccaagttcaagtgcgtcaccaagctcgagggcaagaccgtgcagtacgagaacctgaagtacagcgtgatcgtcaccgtgcacacgggcgaccagcaccaggtcgggaacgagtccaccgagcacggcaccaccgcgaccatcacgccccaggcccccagcaccgagatccagctgaccgactacggggccctcaccctggactgcagcccccgcacgggcctggacttcaacgagatggtgctcctgaccatgaaggagaagtcctggctggtgcacaagcagtggttcctcgacctgccgctgccctggaccagcggggcctccaccagccaggagacgtggaaccggaaggacctcctggtcaccttcaagaccgcccacgcgaagaagcaggaggtggtggtcctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtgatgtgcaccgggagcttcaagctggagaaggaggtggcggagacgcagcacggcaccgtcctcgtgcagatcaagtacgagggcaccgacgccccctgcaagatccccttctccacccaggacgagaagggggtgacgcagaacggccggctgatcaccgccaacccgatcgtcaccgacaaggagaagcccgtgaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtcttcacctccgtggggaagctggtgcaccagatcttcggcaccgcctacggggtcctgttcagcggcgtgtcctggaccatgaagatcgggatcggcgtgctcctgacgtggctgggcctcaacagccgctccaccagcctgtccatgacctgcatcgccgtcgggctggtgaccctctacctgggcgtgatggtccaggccgacagcgggtgcgtgatcaactggaagggccgggagctgaagtgcgggagcggcatcttcgtgacgaacgaggtccacacctggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtcgtggtggacgagcactgcggcaaccgggggccgagcctgcgcaccaccaccgtcacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatcgggcagctcacgtggaacgacctgatccggctgtgcatcatggtgggcgcgaacgcctccgaccgcatggggatgggcaccacctacctcgccctgatggccaccttcaagatgcgcccgatgttcgccgtgggcctcctgttccggcgcctgacgagccgggaggtcctgctcctgaccatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtgctgtccatcgtgagcctgttccccctctgcctgtccacgaccagccagaagaccacctggctgcccgtcctcctgggctccctggggtgcaagccgctcacgatgttcctgatcgccgagaacaagatctggggccgccggagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggaccatgaagatcaaggacgaggagcgcgacgacaccctgaccatcctgctcaaggccaccctgctggccgtgagcggcgtctacccgctctccatccccgccacgctgttcgtgtggtacttctggcagaagaagaagcagcggagcggggtgctgtgggacacccccagcccgcccgaggtcgagcgcgccgtgctcgacgacggcatctaccggatcatgcagcgcggcctgctggggcggagccaggtgggcgtcggggtgttccaggagaacgtgttccacaccatgtggcacgtcacccgcggcgcggtgctgatgtaccaggggaagcggctcgagccctcctgggccagcgtgaagaaggacctgatctcctacggcggcgggtggcgcctgcagggcagctggaacacgggggaggaggtccaggtgatcgccgtggagcccggcaagaaccccaagaacgtccagaccgcccccgggaccttcaagacctccgagggcgaggtgggcgccatcgcgctcgacttcaagcccgggacgagcggcagccccatcgtgaaccgggaggggaagatcgtcggcctgtacggcaacggggtggtgaccacctccggcacctacgtcagcgccatcgcccaggccaaggcgtcccaggaggggcccctgccggagatcgaggacgaggtgttccgcaagcggaacctcacgatcatggacctgcaccccggcagcgggaagacccgccggtacctgcccgccatcgtgcgcgaggccatcaagcggaagctccgcaccctgatcctggccccgacccgcgtcgtggcctccgagatggcggaggccctcaagggcatgcccatccggtaccagacgaccgccgtcaagagcgagcacaccggcaaggagatcgtcgacctgatgtgccacgccaccttcacgatgcgcctgctctcccccgtgcgggtgcccaactacaacatgatcatcatggacgaggcccacttcaccgacccgagctccatcgcggcccgcgggtacatcagcacccgggtcggcatgggggaggccgccgccatcttcatgaccgcgacgccgcccggctccgtggaggccttcccccagagcaacgccgtgatccaggacgaggagcgcgacatcccggagcggtcctggaacagcgggtacgagtggatcaccgacttccccggcaagaccgtctggttcgtgccctccatcaagagcggcaacgacatcgccaactgcctgcgcaagaacgggaagcgggtgatccagctgtcccgcaagaccttcgacacggagtaccagaagaccaagaacaacgactgggactacgtcgtgaccaccgacatcagcgagatgggcgcgaacttccgggccgaccgcgtgatcgacccccggcgctgcctcaagccggtcatcctgaaggacgggcccgagcgggtgatcctggccggccccatgcccgtcacggtggcctccgccgcgcagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgccgcgatcgacggggagtaccgcctgcggggcgaggcccgcaagaccttcgtggagctgatgcggcgcggggacctcccggtctggctgagctacaaggtggcctccgagggcttccagtacagcgaccggcgctggtgcttcgacggcgagcggaacaaccaggtgctggaggagaacatggacgtcgagatctggacgaaggagggggagcgcaagaagctccggccccgctggctggacgcccggacctactccgaccccctggccctccgcgagttcaaggagttcgcggccggccggcgcagcgtgtccggggacctgatcctggagatcggcaagctcccccagcacctgacccagcgggcccagaacgccctggacaacctcgtgatgctgcacaacagcgagcagggcgggcgcgcgtaccggcacgccatggaggagctgccggacaccatcgagacgctcatgctgctggccctcatcgccgtcctgaccggcggggtgaccctgttcttcctctccggccgcgggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccggcagcgcaccccgcaggacaaccagctggcctacgtcgtgatcgggctcctcttcatgatcctgacggtggccgcgaacgagatgggcctgctcgagaccaccaagaaggacctggggatcggccacgtcgccgtggagaaccaccaccacgccgccatgctggacgtggacctccaccccgcctccgcgtggaccctgtacgccgtcgccacgaccatcatcacccccatgatgcggcacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgcgaggcccagaagcgcaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcggaccacctgggccctgtgcgagagcatcaccctcgccacgggccccctgaccaccctgtgggaggggtcccccggcaagttctggaacaccacgatcgccgtcagcatggccaacatcttccgcgggagctacctcgcgggcgccggcctggccttctccctgatgaagtccctcgggggcgggcggcgcggcaccggggcccagggcgagaccctgggcgagaagtggaagcggcagctgaaccagctctccaagagcgagttcaacacctacaagcgctccgggatcatggaggtggaccggagcgaggcgaaggagggcctgaagcgcggggagacgaccaagcacgccgtgtcccggggcaccgccaagctgcgctggttcgtcgagcggaacctcgtgaagccggaggggaaggtgatcgacctgggctgcggccgcgggggctggagctactactgcgccgggctgaagaaggtcaccgaggtgaagggctacacgaagggcgggcccggccacgaggagcccatccccatggccacctacgggtggaacctggtgaagctccactccggcaaggacgtcttcttcatcccgcccgagaagtgcgacaccctgctgtgcgacatcggggagagctcccccaaccccaccatcgaggagggccggacgctccgcgtgctgaagatggtggagccgtggctgcgggggaaccagttctgcatcaagatcctcaacccctacatgcccagcgtcgtggagaccctggagcgcatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccgcttcacgatggcccaccggaagccgacctacgagcgcgacgtcgacctcggggccggcacccggcacgtggccgtggagcccgaggtcgccaacctggacatcatcggccagcgcatcgagaacatcaagcacgagcacaagagcacctggcactacgacgaggacaacccctacaagacgtgggcgtaccacgggtcctacgaggtgaagcccagcggcagcgcctccagcatggtcaacggggtggtgaagctgctcaccaagccgtgggacgtcatccccatggtgacccagatcgccatgaccgacacgacccccttcggccagcagcgggtgttcaaggagaaggtcgacacccgcacccccaaggccaagcgggggacggcccagatcatggaggtgaccgcgaagtggctgtggggcttcctgtcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctcgtccaccgcgagcgggagctgcacaagcaggggaagtgcgccacgtgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggccaagatcacggacatcatggagcccgagcacgcgctgctcgccaagtccatcttcaagctgacctaccagaacaaggtcgtgcgcgtgcagcgcccggccaagaacgggaccgtcatggacgtgatcagccggcgcgaccagcggggctccggccaggtgggcacctacggcctgaacacgttcaccaacatggaggcccagctcatccgccagatggagagcgaggggatcttctcccccagcgagctggagacccccaacctggccggccgggtcctcgactggctggagaagcacggggtggagcgcctgaagcggatggcgatctccggcgacgactgcgtggtcaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagaccgcctgcctgggcaagtcctacgcccagatgtggcagctcatgtacttccaccggcgcgacctgcggctggccgcgaacgccatctgcagcgccgtgccggtggactgggtccccacctcccgcaccacgtggagcatccacgcccaccaccagtggatgaccaccgaggacatgctctccgtgtggaaccgggtgtggatcgaggagaacccctggatggaggacaagacccacatcagctcctggggcgacgtcccctacctgggcaagcgcgaggaccagtggtgcggcagcctgatcgggctcacggcccgcgcgacctgggccaccaacatccaggtggccatcaaccaggtgcggcgcctgatcggcaacgagaactacctggactacatgacctccatgaagcggttcaagaacgagagcgacccggagggggccctctggtga

SEQ ID NO: 8741 - RNA, 9879 nt, synthetic construct
  misc_feature 1..9879: note = derived and/or modified CDS sequence (opt1) from DENV-1__EU482808__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcaccccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacgtcccgcatgctgctgaaccggttcaccatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctgtcccgcgacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8742 - RNA, 9879 nt, synthetic construct
  misc_feature 1..9879: note = derived and/or modified CDS sequence (opt1) from DENV-1__EU482809__SS-prME
  source 1..9879: mol_type = other RNA
agcgtgaccatgctgctgatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtacccgctgtccatccccgccaccctgttcgtctggtacttctggcagaagaagaagcagcggagcggggtgctctgggacacgcccagcccgcccgaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgggaggggaagatcgtgggcctgtacggcaacggggtcgtgacgacctccggcacctacgtgagcgccatcgcccaggccaaggcgtcccaggaggggcccctcccggagatcgaggacgaggtcttccgcaagcggaacctgaccatcatggacctgcaccccggcagcgggaagacgcgccggtacctccccgccatcgtgcgcgaggccatcaagcggcgcctgcgcaccctgatcctcgccccgacccgggtggtcgcctccgagatggcggaggccctgaagggcatgcccatccgctaccagaccacggccgtcaagagcgagcacaccggcaaggagatcgtggacctgatgtgccacgccaccttcaccatgcggctcctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctctcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctgaaggacgggcccgagcgcgtcatcctcgccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacgtactccgaccccctcgccctgcgggagttcaaggagttcgcggccggccgccggagcgtctccggggacctgatcctcgagatcggcaagctgccccagcacctgacccagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgacgggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagacgaccaagaaggacctggggatcggccacgtggccgtcgagaaccaccaccacgccgccatgctcgacgtggacctgcaccccgcctccgcgtggaccctgtacgccgtggccaccacgatcatcacccccatgatgcgccacaccatcgagaacaccacggccaacatcagcctcaccgccatcgcgaaccaggccgccatcctgatggggctggacaagggctggccgatctccaagatggacatcggcgtccccctcctggccctggggtgctacagccaggtgaaccccctcaccctgaccgcggccgtgctgatgctcgtcgcccactacgccatcatcggccccgggctgcaggccaaggcgacgcgcgaggcccagaagcggaccgccgccggcatcatgaagaacccgaccgtggacgggatcgtggccatcgacctggaccccgtcgtgtacgacgcgaagttcgagaagcagctcggccagatcatgctgctgatcctctgcacctcccagatcctgctgatgcgcacgacctgggccctctgcgagagcatcaccctggccaccggccccctgacgaccctctgggaggggtcccccggcaagttctggaacaccaccatcgccgtgagcatggccaacatcttccgggggagctacctggcgggcgccggcctggccttctccctcatgaagtccctcgggggcgggcgccgggggacgggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagaccacgaagcacgccgtgtcccgcggcaccgccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacgtacgggtggaacctcgtgaagctgcactccggcaaggacgtgttcttcatcccgcccgagaagtgcgacaccctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagacgctggagcagatgcagcggaagcacggcggcatgctcgtgcgcaaccccctgtcccggaacagcacccacgagatgtactgggtgtcctgcgggaccggcaacatcgtcagcgcggtgaacatgacctcccgcatgctgctcaaccgcttcaccatggcccaccggaagccgacgtacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctcctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctgtggggcttcctctcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacacggccggctgggacacccggatcaccgaggacgacctgcagaacgaggccaagatcaccgacatcatggagcccgagcacgcgctcctggccaagtccatcttcaagctgacgtaccagaacaaggtggtccgcgtgcagcgcccggccaagaacgggaccgtgatggacgtcatcagccggcgcgaccagcggggctccggccaggtgggcacctacggcctcaacaccttcacgaacatggaggcccagctgatccgccagatggagagcgaggggatcttctcccccagcgagctggagacccccaacctcgccggccgggtgctggactggctggagaagcacggggtcgagcgcctcaagcggatggcgatctccggcgacgactgcgtggtgaagcccatcgacgaccgcttcgccaccgccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagacggcctgcctcggcaagtcctacgcccagatgtggcagctgatgtacttccaccggcgcgacctgcggctcgccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacgtgagctcctggggcgacgtcccctacctgggcaagcgcgaggaccagtggtgcggcagcctcatcgggctgaccgcccgcgcgacgtgggccaccaacatccaggtggccatcaaccaggtgcggcgcctgctcggcaacgagaactacctggactacatgacctccatgaagcggttcaagaacgagagcgacccggagggggccctgtggtga

SEQ ID NO: 8743 - RNA, 9879 nt, synthetic construct
  misc_feature 1..9879: note = derived and/or modified CDS sequence (opt1) from DENV-1__EU482810__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacgcagatgtgcgaccaccgcctcatgagcgccgccatcaaggactccaaggccgtgcacgccgacatgggctactggatcgagagcgagaagaacgagacctggaagctggcgcgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtggtcgacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgaccggcaccctggccgtgttcttcctgctcatcatggggcagctgacctggaacgacctgatccggctctgcatcatggtgggcgcgaacgcctccgaccgcatggggatgggcacgacctacctggccctgatggccaccttcaagatgcgcccgatgttcgccgtcgggctcctgttccggcgcctgaccagccgggaggtgctcctgctgacgatcgggctctccctggtggcgagcgtcgagctgcccaactccctcgaggagctgggcgacgggctggccatgggcatcatgatcctcaagctgctgaccgacttccagagccaccagctctgggccaccctgctgtccatgaccttcatccgcacgaccttcagcctccactacgcctggaagaccatggcgatggtgctgtccatcgtcagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgccggcggcatgctcatcgcgtgctacgtgatctccgggagctccgccgacctgagcctggagaaggccgccgaggtctcctgggaggaggaggccgagcacagcggcgcgtcccacaacatcctcgtggaggtgcaggacgacgggacgatgaagatcaaggacgaggagcgcgacgacaccctgaccatcctgctcaaggccaccctgctggccgtcagcggcgtgtacccgctctccatccccgccaccctgttcgtgtggtacttctggcagaagaagaagcagcggagcggggtcctgtgggacacgcccagcccgcccgaggtgcagcgcgccgtgctcgacgacggcatctaccggatcatgcagcgcggcctgctggggcggagccaggtcggcgtgggggtgttccaggagaacgtcttccacaccatgtggcacgtgacccgcggcgcggtgctgatgtaccaggggaagcggctcgagccctcctgggccagcgtcaagaaggacctgatctcctacggcggcgggtggcgcctgcagggcagctggaacaccggggaggaggtccaggtgatcgccgtcgagcccggcaagaaccccaagaacgtgcagacggcccccgggaccttcaagacctccgagggcgaggtgggcgccatcgcgctcgacttcaagcccgggaccagcggcagccccatcgtcaaccgggaggggaagatcgtgggcctgtacggcaacggggtggtcacgacctccggcacctacgtgagcgccatcgcccaggccaaggcgtcccaggaggggcccctgccggagatcgaggacgaggtgttccgcaagcggaacctcaccatcatggacctgcaccccggcagcgggaagacgcgccggtacctgcccgccatcgtccgcgaggccatcaagcggaagctccgcaccctgatcctggccccgacccgcgtggtggcctccgagatggcggaggccctcaagggcatgcccatccggtaccagaccacggccgtcaagagcgagcacaccggcaaggagatcgtggacctgatgtgccacgccaccttcaccatgcgcctgctctcccccgtgcgggtccccaactacaacatgatcatcatggacgaggcccacttcacggacccgagctccatcgcggcccgcgggtacatcagcacccgggtgggcatgggggaggccgccgccatcttcatgaccgcgacgccgcccggctccgtggaggccttcccccagagcaacgccgtcatccaggacgaggagcgcgacatcccggagcggtcctggaacagcgggtacgagtggatcacggacttccccggcaagaccgtgtggttcgtgccctccatcaagagcggcaacgacatcgccaactgcctgcgcaagaacgggaagcgggtcatccagctgtcccgcaagaccttcgacaccgagtaccagaagacgaagaacaacgactgggactacgtggtgaccaccgacatcagcgagatgggcgcgaacttccgggccgaccgcgtcatcgacccccggcgctgcctcaagccggtgatcctgaaggacgggcccgagcgggtgatcctggccggccccatgcccgtcaccgtggcctccgccgcgcagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccgcctgcggggcgaggcccgcaagaccttcgtcgagctgatgcggcgcggggacctcccggtgtggctgagccacaaggtggcctccgagggcttccagtacagcgaccggcgctggtgcttcgacggcgagcggaacaaccaggtcctggaggagaacatggacgtggagatctggaccaaggagggggagcgcaagaagctccggccccgctggctggacgcccggacgtactccgaccccctggccctccgcgagttcaaggagttcgcggccggccggcgcagcgtgtccggggacctgatcctggagatcggcaagctcccccagcacctgacccagcgggcccagaacgccctggacaacctcgtcatgctgcacaacagcgagcagggcgggcgcgcgtaccggcacgccatggaggagctgccggacaccatcgagaccctcatgctgctggccctcatcgccgtgctgacgggcggggtgaccctgttcttcctctccggccgcgggctgggcaagaccagcatcggcctgctctgcgtcatggcctccagcgtgctgctgtggatggcgtccgtggagccccactggatcgccgccagcatcatcctcgagttcttcctgatggtcctgctcatccccgagcccgaccggcagcgcaccccgcaggacaaccagctggcctacgtggtgatcgggctcctgttcatgatcctgaccgtcgccgcgaacgagatgggcctgctcgagacgaccaagaaggacctggggatcggccacgtggccgtggagaaccaccaccacgccgccatgctggacgtcgacctccaccccgcctccgcgtggaccctgtacgccgtggccaccacgatcatcacccccatgatgcggcacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtcaaccccctgaccctcaccgcggccgtgctgatgctggtggcccactacgccatcatcggccccgggctccaggccaaggcgacgcgcgaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacctcccagatcctcctgatgcggacgacctgggccctgtgcgagagcatcaccctcgccaccggccccctgacgaccctgtgggaggggtcccccggcaagttctggaacaccaccatcgccgtgagcatggccaacatcttccgcgggagctacctcgcgggcgccggcctggccttctccctgatgaagtccctcgggggctcccggcgcgggacgggcgcccagggggagaccctgggcgagaagtggaagcggcagctgaaccagctcagcaagtccgagttcaacacctacaagcgcagcggcatcatggaggtggaccggtccgaggcgaaggaggggctgaagcgcggcgagaccacgaagcacgccgtcagccgggggaccgccaagctgcgctggttcgtggagcggaacctcgtgaagccggagggcaaggtcatcgacctggggtgcggccgcggcgggtggtcctactactgcgccggcctgaagaaggtgaccgaggtgaaggggtacaccaagggcgggcccggccacgaggagcccatccccatggccacgtacggctggaacctggtcaagctccacagcgggaaggacgtgttcttcatcccgcccgagaagtgcgacaccctgctgtgcgacatcggcgagtccagccccaaccccaccatcgaggaggggcggaccctccgcgtgctgaagatggtcgagccgtggctgcggggcaaccagttctgcatcaagatcctcaacccctacatgccctccgtggtggagacgctggagcagatgcagcgcaagcacgggggcatgctggtccggaaccccctcagccgcaactccacccacgagatgtactgggtgagctgcggcaccgggaacatcgtgtccgcggtcaacatgaccagccggatgctgctgaaccgcttcaccatggcccaccgcaagccgacgtacgagcgggacgtggacctcggcgccgggacccgccacgtggccgtcgagcccgaggtggccaacctggacatcatcggccagcggatcgagaacatcaagcacgagcacaagtccacctggcactacgacgaggacaacccctacaagacctgggcgtaccacggcagctacgaggtgaagcccagcgggtccgccagctccatggtcaacggcgtggtcaagctgctcacgaagccgtgggacgtgatccccatggtgacccagatcgccatgaccgacaccacgcccttcgggcagcagcgcgtcttcaaggagaaggtggacacccggacccccaaggccaagcgcggcaccgcccagatcatggaggtgacggcgaagtggctgtgggggttcctgagccggaacaagaagccgcgcatctgcacccgggaggagttcacccgcaaggtccggtccaacgccgccatcggcgccgtgttcgtggacgagaaccagtggaacagcgcgaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggctcccgcgccatctggtacatgtggctcggggcgcggttcctggagttcgaggccctgggcttcatgaacgaggaccactggttcagccgcgagaactccctcagcggcgtcgagggggagggcctgcacaagctggggtacatcctccgggacatctccaagatccccggcgggaacatgtacgccgacgacacggccggctgggacacccgcatcaccgaggacgacctgcagaacgaggccaagatcaccgacatcatggagcccgagcacgcgctgctcgccaagagcatcttcaagctgacgtaccagaacaaggtggtgcgggtccagcgcccggccaagaacggcaccgtgatggacgtgatctcccgccgggaccagcgcgggagcggccaggtcgggacctacggcctgaacaccttcacgaacatggaggcccagctcatccggcagatggagtccgagggcatcttcagcccctccgagctggacacccccaacctggccgggcgcgtgctcgactggctggagaagcacggcgtggagcggctgaagcgcatggcgatcagcggggacgactgcgtcgtgaagcccatcgacgaccggttcgccaccgccctcaccgccctgaacgacatgggcaaggtgcgcaaggacatcccgcagtgggagcccagcaaggggtggaacgactggcagcaggtccccttctgctcccaccacttccaccagctgatcatgaaggacggccgggagatcgtggtgccctgccgcaaccaggacgagctcgtcggccgggcccgcgtgagccagggggcgggctggtccctgcgggagacggcctgcctgggcaagagctacgcccagatgtggcagctcatgtacttccaccgccgggacctgcgcctggccgcgaacgccatctgctccgccgtgccggtcgactgggtgcccaccagccggaccacctggtccatccacgcccaccaccagtggatgacgaccgaggacatgctcagcgtgtggaaccgcgtctggatcgaggagaacccctggatggaggacaagacccacatctccagctggggcgacgtgccctacctggggaagcgggaggaccagtggtgcggctccctgatcggcctcaccgcccgcgcgacgtgggccaccaacatccaggtggccatcaaccaggtccgccggctgctggggaacgagaactacctcgactacatgaccagcatgaagcgcttcaagaacgagtccggcccggagggggccctgtggtga

SEQ ID NO: 8744 - RNA, 9879 nt, synthetic construct
  misc_feature 1..9879: note = derived and/or modified CDS sequence (opt1) from DENV-1__EU482811__SS-prME
  source 1..9879: mol_type = other RNA
agcgtgaccatgctgctgatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgggagaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggtgcaggggaagaagatgatccggccccagcccatggagtacaagtacagctggaagtcctggggcaaggccaagatcatcggcgccgacgtccagaacagcacgttcatcatcgacgggcccaacaccccggagtgccccgacgaccagcgcgcctggaacatctgggaggtggaggactacggcttcgggatcttcaccaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggcccaagagccacaccctctggtccaacggcgtgctggagagcgagatgatcatccccaagatccacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgaagtccatggtcagcgccggctccggcgaggtggacagcttctccctggggctgctctgcatcagcatcatgatcgaggaggtgatgcggtcccgctggagccggaagatgctgatgaccggcaccctggccgtcttcttcctcctgatcatggggcagctgacctggaacgacctcatccgcctgtgcatcatggtgggcgccaacgcgtccgaccgcatggggatgggcacgacctacctggccctcatggccaccttcaagatgcggccgatgttcgccgtgggcctgctgttccgccggctcaccagccgcgaggtcctgctgctcacgatcgggctgtccctggtggccagcgtcgagctccccaactccctggaggagctgggcgacgggctcgcgatgggcatcatgatcctgaagctgctcaccgacttccagagctaccagctgtgggccaccctgctctccctgaccttcatcaagacgaccttcagcctgcactacgcctggaagaccatggccatggtgctctccatcgtgagcctgttccccctgtgcctctccaccacgagccagaagaccacctggctgcccgtcctgctcggctccctggggtgcaagccgctgaccatgttcctcatcgcggagaacaagatctggggccgcaagagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggacgatgaagatcaaggacgaggagcgcgacgacaccctcaccatcctgctgaaggcgaccctcctggccgtgagcggcgtctacccgctgtccatccccgccaccctcttcgtgtggcacttctggcagaagaagaagcagcggagcggggtgctgtgggacacgcccagcccgcccgaggtcgagcgcgccgtgctggacgacggcatctaccggatcatgcagcgcggcctgctcgggcggagccaggtgggcgtcggggtgttccaggagaacgtgttccacaccatgtggcacgtcacccgcggcgccgtgctgatgtaccaggggaagcggctggagccctcctgggcgagcgtgaagaaggacctcatctcctacggcggcgggtggcgcctgcagggcagctggaacaccggggaggaggtccaggtgatcgccgtggagcccggcaagaaccccaagaacgtccagacggcccccgggaccttcaagacccccgagggcgaggtgggcgccatcgccctggacttcaagcccgggacctccggcagccccatcgtgaaccgggaggggaagatcgtcggcctctacggcaacggggtggtgacgaccagcggcacctacgtctccgcgatcgcccaggccaaggccagccaggaggggccgctgcccgagatcgaggacgaggtgttccgcaagcggaacctgaccatcatggacctccaccccggctccgggaagacgcgccggtacctgccggcgatcgtgcgcgaggccatcaagcggaagctgcgcaccctcatcctggcccccacccgcgtcgtggccagcgagatggccgaggcgctgaagggcatgcccatccggtaccagaccacggccgtgaagtccgagcacaccggcaaggagatcgtcgacctcatgtgccacgccaccttcaccatgcgcctgctgagccccgtgcgggtgccgaactacaacatgatcatcatggacgaggcccacttcacggacccctccagcatcgccgcgcgcgggtacatctccacccgggtcggcatgggggaggccgccgccatcttcatgaccgccacgccgcccggcagcatggaggcgttcccgcagtccaacgccgtgatccaggacgaggagcgcgacatccccgagcggagctggaactccgggtacgagtggatcacggacttccccggcaagaccgtgtggttcgtccccagcatcaaggccggcaacgacatcgccaactgcctccgcaagaacgggaagcgggtgatccagctgtcccgcaagaccttcgacaccgagtaccagaagacgaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgaccgtcgcctccgccgcgcagcgccgggggcgcatcggccggaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacgtactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagaccctgatgctcctggccctgatcgccgtgctcacgggcggggtcaccctgttcttcctgtccggcaaggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccgccagcggacgccccaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcaccccgatgatgcgccacaccatcgagaacaccacggccaacatcagcctgaccgccatcgcgaaccaggccgccatcctgatggggctcgacaagggctggcccatctccaagatggacatcggcgtccccctgctggccctcgggtgctacagccaggtgaaccccctgaccctgaccgcggccgtgctcatgctggtcgcccactacgccatcatcggcccggggctgcaggccaaggcgacgcgggaggcccagaagcgcaccgccgccggcatcatgaagaaccccaccatcgacgggatcgtggccatcgacctcgaccccgtggtctacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtccccgggcaagttctggaacaccaccatcgccgtgagcatggccaacatcttccgggggtcctacctggcgggcgccggcctcgccttcagcctgatgaagtccctcgggggcgggcgccgggggacgggggcccagggcgagaccctcggcgagaagtggaagcgccagctgaaccagctgtccaagagcgagttcaacacctacaagcggtccgggatcatggaggtggaccgcagcgaggcgaaggagggcctcaagcgcggggagaccacgaagcacgccgtctcccgcggcaccgccaagctgcggtggttcgtggagcgcaacctggtgaagcccgaggggaaggtcatcgacctgggctgcggccgcgggggctggagctactactgcgccgggctcaagaaggtgaccgaggtgaagggctacaccaagggcggccccggccacgaggagcccatcccgatggccacgtacgggtggaacctggtcaagctgcactccggcaaggacgtgttcttcatcccgcccgagaagtgcgacaccctcctgtgcgacatcggggagagctcccccaacccgaccatcgaggagggccgcaccctgcgggtgctcaagatggtcgagccctggctgcgcgggaaccagttctgcatcaagatcctgaacccctacatgcccagcgtggtggagacgctcgagcagatgcagcggaagcacggcggcatgctggtccgcaacccgctgtcccggaacagcacccacgagatgtactgggtgtcctgcgggaccggcaacatcgtgagcgcggtcaacatgacctcccgcatgctcctgaaccggttcaccatggcccaccgcaagcccacgtacgagcgcgacgtggacctgggggccggcacccggcacgtggccgtcgagcccgaggtggccaacctcgacatcatcggccagcgcatcgagaacatcaagcacgagcacaagagcacctggcactacgacgaggacaacccctacaagacctgggcgtaccacgggtcctacgaggtgaagccgagcggctccgccagcagcatggtcaacggggtggtcaagctgctgacgaagccctgggacgtgatccccatggtgacccagatcgccatgaccgacaccacgcccttcggccagcagcgggtcttcaaggagaaggtggacacccgcaccccgaaggccaagcgggggaccgcccagatcatggaggtgacggcgcgctggctctggggcttcctgtcccggaacaagaagccccgcatctgcacccgggaggagttcacccgcaaggtccggagcaacgccgccatcggcgccgtgttcgtggacgagaaccagtggaactccgcgaaggaggccgtcgaggacgaccgcttctgggacctggtgcaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtcgagggcgaggggctccacaagctgggctacatcctgcgggacatcagcaagatccccgggggcaacatgtacgccgacgacacggccggctgggacacccgcatcaccgaggacgacctccagaacgaggccaagatcaccgacatcatggagccggagcacgcgctgctggccaagtccatcttcaagctcacgtaccagaacaaggtggtgcgggtccagcgccccgccaagaacgggaccgtgatggacgtgatcagccgccgggaccagcgcggctccgggcaggtcggcacctacggcctgaacaccttcacgaacatggaggcccagctgatccggcagatggagagcgaggggatcttcctccccaacgagctggagacccccaacctggccggccgcgtgctcgactggctggagaagtacggggtggagcggctgaagcgcatggcgatctccggcgacgactgcgtcgtgaagccgatcgacgaccggttcgccaccgccctcaccgccctgaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctcgtcgggcgggcccgcgtgagccagggcgcggggtggtccctgcgggagacggcctgcctgggcaagagctacgcccagatgtggcagctcatgtacttccaccgccgggacctgcgcctggccgcgaacgccatctgcagcgccgtgcccgtcgactgggtgcccacctcccggaccacctggagcatccacgcccaccaccagtggatgacgaccgaggacatgctctccgtgtggaaccgcgtctggatcgaggagaacccctggatggaggacaagacccggatcagctcctgggaggacgtgccgtacctggggaagcgcgaggaccagtggtgcggcagcctgatcggcctcaccgcccgcgcgacgtgggccaccaacatccaggtggccatcaaccaggtccggcgcctgatcgggaacgagaactactccgactacatgaccagcatgaagcggttcaagaacgagtccgagcccgagggcgccctgtggtga

SEQ ID NO: 8745 - RNA, 9879 nt, synthetic construct
  misc_feature 1..9879: note = derived and/or modified CDS sequence (opt1) from DENV-1__EU482812__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggccacccagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgcgggcatcctcgcccaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcgtggaacatctgggaggtggaggactacggcttcgggatcttcacgaccaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgcgaacgccagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctccccgtgctgctgggcagcctcgggtgcaagccgctgaccatgttcctgatcgccgagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgggacgacaccctgaccatcctcctgaaggccacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgcggtgctcatgtaccaggggaagcgcctggagcccagctgggcctccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgcgaggggaagatcgtgggcctgtacggcaacggggtggtcaccaccagcggcacgtacgtgagcgccatcgcccaggccaaggcgtcccaggaggggccgctccccgagatcgaggacgaggtgttccggaagcgcaacctgaccatcatggacctgcaccccggcagcgggaagacccggcgctacctcccggccatcgtccgggaggccatcaagcgcaagctgcgcaccctgatcctcgcccccacgcgggtggtggcctccgagatggcggaggccctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgacggcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgcgaacttccgcgccgaccgggtcatcgacccgcgccggtgcctgaagcccgtgatcctgaaggacgggcccgagcgcgtgatcctcgccggccccatgccggtcaccgtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcgggctcctgttcatgatcctgaccgtcgccgcgaacgagatgggcctcctggagaccaccaagaaggacctggggatcggccacgtggccgtggagaaccaccaccacgccgccatgctcgacgtcgacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtcaaccccctcacgctgaccgcggccgtgctgatgctcgtggcccactacgccatcatcggcccggggctgcaggccaaggcgacccgcgaggcccagaagcggaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggcgaaggagggcctgaagcgcggggagaccaccaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgcggtcaacatgacgtcccgcatgctgctcaaccgcttcaccatggcccaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgcgaagtggctgtggggcttcctctcccgcaacaagaagccccggatctgcacccgcgaggagttcacgcggaaggtccgcagcaacgccgccatcggcgccgtgttcgtggacgagaaccagtggaactccgcgaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgcgctcctggccaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctggagaagtacggcgtggagcggctcaagcgcatggcgatctccggggacgactgcgtcgtgaagccgatcgacgaccggttcgccacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggcgggctggagcctgcgggagaccgcctgcctcgggaagtcctacgcccagatgtggcagctgatgtacttccaccgccgggacctgcgcctcgccgcgaacgccatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggcgacctgggccaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8746 - RNA, 9879 nt, synthetic construct
  misc_feature 1..9879: note = derived and/or modified CDS sequence (opt1) from DENV-1__EU482813__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgaggaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacacgaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtcccccggcaagttctggaacacgaccatcgccgtgagcatggccaacatcttccgggggagctacctcgccggcgcgggcctggccttctccctgatgaagtccctcgggggcgggcgccggggcaccggggcccagggcgagaccctgggcgagaagtggaagcgccagctgaaccagctctccaagagcgagttcaacacgtacaagcggtccgggatcatggaggtcgaccgcagcgaggccaaggagggcctgaagcgcggggagaccaccaagcacgcggtgtcccgcggcaccgccaagctgcggtggttcgtggagcgcaacctcgtcaagccggaggggaaggtgatcgacctgggctgcggccgcggcgggtggagctactactgcgccgggctgaagaaggtgacggaggtcaaggggtacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgccgtgaacatgacgtcccgcatgctgctgaaccggttcaccatggcgcaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcctaccacgggtcctacgaggtcaagcccagcggcagcgcgtccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgccaagtggctgtggggcttcctgtcccgcaacaagaagccgcggatctgcacccgcgaggagttcacgcggaaggtgcgcagcaacgcggccatcggcgccgtgttcgtcgacgagaaccagtggaactccgccaaggaggcggtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgccctgctcgcgaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggccatctccggcgacgactgcgtggtgaagcccatcgacgaccgcttcgcgacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggccacctgggcgaccaacatccaggtcgccatcaaccaggtgcgccgcctgatcggcaacgagaactacctggactacatgacctccatgaagcggttcaagaacgagagcgacccggagggggccctctggtga

SEQ ID NO: 8747 - RNA, 9879 nt, synthetic construct
  misc_feature 1..9879: note = derived and/or modified CDS sequence (opt1) from DENV-1__EU482814__SS-prME
  source 1..9879: mol_type = other RNA
agcgtgacgatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcttcgggctcgagacgcgcaccgagacctggatgagctccgagggcgcctggaagcagatccagcgggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcagccgcgacttcgtggaggggctgtccggcgccacgtgggtggacgtcgtgctggagcacgggagctgcgtgaccaccatggccaaggacaagcccaccctcgacatcgagctgctgaagacggaggtcaccaaccccgcggtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctgatcacgtgcgccaagttcaagtgcgtgaccaagctggagggcaagaccgtccagtacgagaacctcaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctgaccctcgactgcagcccccggacgggcctggacttcaacgagatggtcctgctcaccatgaaggagaagtcctggctggtgcacaagcagtggttcctggacctcccgctgccctggaccagcggggcctccaccagccaggagacgtggaaccggaaggacctgctcgtgaccttcaagaccgcccacgcgaagaagcaggaggtcgtggtgctgggctcccaggagggcgccatgcacaccgccctgacgggggccaccgagatccagaccagcggcaccacgaccatcttcgccgggcacctcaagtgccgcctgaagatggacaagctgaccctcaagggcatgtcctacgtcatgtgcaccgggagcttcaagctggagaaggaggtggcggagacgcagcacggcaccgtgctggtccagatcaagtacgagggcaccgacgccccctgcaagatccccttctccacccaggacgagaagggggtgacgcagaacggccggctcatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctcgtgcaccagatcttcggcaccgcctacggggtgctgttcagcggcgtctcctggaccatgaagatcgggatcggcgtgctgctcacgtggctgggcctgaacagccgctccaccagcctctccatgacctgcatcgccgtggggctggtcaccctgtacctcggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacacgctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcaccacggtggtcgtggacgagcactgcggcaaccgggggccgagcctccgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctcgtcaagagcatggtgagcgccggctccggcgaggtcgacagcttctccctggggctgctctgcatcagcatcatgatcgaggaggtgatgcgctcccggtggagccgcaagatgctgatgaccggcaccctggccgtgttcttcctcctgatcatggggcagctgacgtggaacgacctcatccggctgtgcatcatggtcggcgcgaacgcctccgaccgcatggggatgggcaccacctacctggccctcatggccaccttcaagatgcgcccgatgttcgccgtgggcctgctgttccggcgcctcacgagccgggaggtgctgctgctcaccatcgggctgtccctggtcgcgagcgtggagctccccaactccctggaggagctgggcgacgggctcgccatgggcatcatgatcctgaagctgctcaccgacttccagagccaccagctgtgggccaccctgctctccctgacgttcatcaagaccaccttcagcctgcactacgcctggaagaccatggcgatggtcctctccatcgtgagcctgttccccctgtgcctctccacgaccagccagaagaccacctggctgcccgtgctgctcggctccctggggtgcaagccgctgacgatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggaccatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacccccagcccgcccgaggtggagcgggccgtcctggacgacggcatctaccgcatcatgcagcggggcctcctggggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctggacttcaagcccgggacgagcggcagccccatcgtgaaccgcgaggggaagatcgtgggcctctacggcaacggggtcgtgaccacctccggcacctacgtgagcgccatcgcccaggccaaggcgtcccaggaggggcccctgccggagatcgaggacgaggtcttccggaagcgcaacctgacgatcatggacctccaccccggcagcgggaagacccggcgctacctgcccgccatcgtgcgggaggccatcaagcgcaagctgcggaccctcatcctggccccgacccgcgtggtcgcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctccggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctgaagccggtgatcctcaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctgaacaacgacgaggaccacgcccactggaccgaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggccctgcgggagttcaaggagttcgcggccggccgccggagcgtctccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagacgctgatgctcctggccctgatcgccgtgctcaccggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccgccatgctggacgtggacctgcaccccgcctccgcgtggaccctctacgccgtggccacgaccatcatcacccccatgatgcgccacaccatcgagaacacgaccgccaacatcagcctgaccgccatcgcgaaccaggccgccatcctgatggggctcgacaagggctggccgatctccaagatggacatcggcgtccccctgctggccctcgggtgctacagccaggtgaaccccctgaccctgacggcggccgtgctcatgctggtcgcccactacgccatcatcggccccgggctgcaggccaaggcgacccgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgccgtgagcatggccaacatcttccgggggagctacctggcgggcgccggcctcgccttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagacgaccaagcacgccgtgtcccgcggcaccgccaagctgcggtggttcgtggagcgcaacctggtcaagccggaggggaaggtgatcgacctcggctgcggccgcggcgggtggagctactactgcgccgggctgaagaaggtgaccgaggtcaaggggtacacgaagggcgggcccggccacgaggagcccatccccatggccacctacgggtggaacctggtgaagctgcactccggcaaggacgtgttcttcatcccgcccgagaagtgcgacaccctcctgtgcgacatcggggagagctcccccaaccccaccatcgaggagggccgcacgctgcgggtcctcaagatggtggagccgtggctgcgcgggaaccagttctgcatcaagatcctgaacccctacatgcccagcgtggtcgagaccctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccggttcacgatggcccaccgcaagccgacctacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagcccgagcacgcgctgctggccaagtccatcttcaagctcacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgacggccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagaccgcctgcctgggcaagtcctacgcccagatgtggcagctgatgtacttccaccggcgcgacctccggctggccgcgaacgccatctgcagcgccgtcccggtggactgggtgcccacctcccgcaccacgtggagcatccacgcccaccaccagtggatgaccaccgaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgacggcccgggcgacctgggccaccaacatccaggtcgccatcaaccaggtgcgccgcctcatcggcaacgagaactacctggactacatgacctccatgaagcggttcaagaacgagagcgacccggagggggccctgtggtga

SEQ ID NO: 8748 - RNA, 9879 nt, synthetic construct
  misc_feature 1..9879: note = derived and/or modified CDS sequence (opt1) from DENV-1__EU482815__SS-prME
  source 1..9879: mol_type = other RNA
agcgtgaccatgctgctcatgctgatgcccgccgccctggcgttccacctcaccacgcggggcggggagccccacatgatcgtgagcaagcaggagcggggcaagagcctgctgttcaagaccagcgccggggtgaacatgtgcaccctcatcgccatggacctgggcgagttctgcgaggacaccatgacgtacaagtgcccccgcatcaccgaggccgagcccgacgacgtggactgctggtgcaacgccaccgacacctgggtgacgtacgggacctgcagccagaccggcgagcaccggcgggacaagcggtccgtggcgctggcgccccacgtgggcctcgggctggagacccgcacggagacctggatgagctccgagggcgcctggaagcagatccagcgggtcgagacctgggccctgcgccaccccgggttcaccgtgatcgccctgttcctggcccacgccatcggcacgagcatcacccagaaggggatcatcttcatcctgctcatgctggtgaccccctccatggccatgcggtgcgtcggcatcggcagccgcgacttcgtggaggggctgtccggcgccacctgggtggacgtcgtgctcgagcacgggagctgcgtgacgaccatggcgaaggacaagcccaccctggacatcgagctgctcaagaccgaggtcacgaaccccgccgtgctgcggaagctgtgcatcgaggccaagatctccaacaccaccaccgacagccgctgcccgacgcagggcgaggccaccctcgtggaggagcaggacgccaacttcgtctgccggcgcaccttcgtggaccggggctgggggaacggctgcgggctgttcggcaaggggtccctgatcacgtgcgcgaagttcaagtgcgtgacgaagctcgagggcaagaccgtccagtacgagaacctgaagtacagcgtgaccgtgaccgtccacacgggcgaccagcaccaggtggggaacgagtccaccgagcacggcaccaccgccaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcgcacgccaagaagcaggaggtcgtggtgctgggctcccaggagggcgccatgcacaccgccctcacgggggccaccgagatccagaccagcggcaccacgaccatcttcgcggggcacctgaagtgccgcctgaagatggacaagctcaccctgaagggcatgtcctacgtcatgtgcaccgggagcttcaagctggagaaggaggtggccgagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggcggagccgcccttcggggagagctacatcgtgatcggcgccggcgagaaggccctgaagctgtcctggttcaagaaggggagctccatcggcaagatgttcgaggccaccgcccgcggggcgcggcgcatggccatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggcggacagcgggtgcgtcatcaactggaagggccgggagctgaagtgcgggagcggcatcttcgtgacgaacgaggtgcacacctggaccgagcagtacaagttccaggccgactccccgaagcgcctcagcgccgccatcggcaaggcctgggaggagggggtctgcggcatccggtccgcgacccgcctggagaacatcatgtggaagcagatcagcaacgagctgaaccacatcctcctggagaacgacatgaagttcaccgtggtggtcggggacgtggccggcatcctggcccaggggaagaagatgatccggccccagcccatggagtacaagtactcctggaagtcctggggcaaggccaagatcatcggcgcggacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgcggacatgggctactggatcgagagcgagaagaacgagacctggaagctcgcccgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgcggtgttcttcctgctgatcatggggcagctcacgtggaacgacctgatccggctgtgcatcatggtcggcgccaacgcctccgaccgcatggggatgggcaccacctacctcgccctgatggccaccttcaagatgcgcccgatgttcgcggtgggcctcctcttccggcgcctgacgagccgggaggtgctgctcctgaccatcgggctgtccctcgtcgccagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcgtggaagaccatggccatggtcctgtccatcgtgagcctgttccccctctgcctgtccacgaccagccagaagaccacctggctgcccgtgctcctgggctccctggggtgcaagccgctcacgatgttcttcatcgccgagaacaagatctggggccgcaagagctggcccctgaacgaggggatcatggccgtcggcatcgtgagcatcctgctctccagcctgctgaagaacgacgtgcccctcgccgggcccctgatcgcgggcggcatgctgatcgcctgctacgtcatctccgggagctccgccgacctcagcctggagaaggccgccgaggtgtcctgggaggaggaggcggagcacagcggcgcctcccacaacatcctggtggaggtccaggacgacgggaccatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacccccagcccgcccgaggtggagcgggcggtcctggacgacggcatctaccgcatcatgcagcggggcctcctggggcgcagccaggtgggcgtgggggtcttccaggagaacgtgttccacaccatgtggcacgtgacccggggcgccgtcctgatgtaccaggggaagcgcctggagccctcctgggccagcgtgaagaaggacctcatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgcgatcgccctggacttcaagcccgggacgagcggcagccccatcgtgaaccgcgaggggaagatcgtgggcctctacggcaacggggtcgtgaccacctccggcacctacgtgagcgccatcgcccaggcgaaggcctcccaggaggggcccctgccggagatcgaggacgaggtcttccggaagcgcaacctgacgatcatggacctccaccccggcagcgggaagacccggcgctacctgcccgccatcgtgcgggaggccatcaagcgcaagctgcggaccctcatcctggccccgacccgcgtggtcgcgtccgagatggccgaggccctgaagggcatgcccatccgctaccagacgaccgccgtcaagagcgagcacaccggcaaggagatcgtggacctcatgtgccacgccaccttcacgatgcggctgctgtcccccgtccgcgtgcccaactacaacatgatcatcatggacgaggcgcacttcaccgacccgagctccatcgccgcccgggggtacatcagcacccgcgtgggcatgggggaggccgccgcgatcttcatgaccgccacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgcgaactgcctccggaagaacgggaagcgcgtgatccagctgtcccggaagaccttcgacacggagtaccagaagaccaagaacaacgactgggactacgtggtcaccaccgacatcagcgagatgggcgccaacttccgcgccgaccgggtgatcgacccccgccggtgcctgaagccggtgatcctcaaggacgggcccgagcgcgtcatcctggccggccccatgcccgtgacggtcgcctccgcggcccagcggcgcgggcggatcggccgcaaccacaacaaggagggcgaccagtacatctacatggggcagccgctgaacaacgacgaggaccacgcccactggaccgaggccaagatgctcctggacaacatcaacacccccgagggcatcatccccgccctgttcgagcccgagcgggagaagtccgcggccatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggacgaaggagggggagcggaagaagctgcgcccccggtggctcgacgcccgcacctactccgaccccctggcgctgcgggagttcaaggagttcgccgccggccgccggagcgtctccggggacctcatcctggagatcggcaagctgccccagcacctcacccagcgcgcccagaacgcgctggacaacctggtgatgctccacaacagcgagcagggcgggcgggcctaccgccacgccatggaggagctgccggacaccatcgagacgctgatgctcctggccctgatcgccgtgctcaccggcggggtcaccctgttcttcctgtccggccgggggctcggcaagaccagcatcggcctgctgtgcgtgatggcgtccagcgccctcctgtggatggcctccgtggagccccactggatcgccgccagcatcatcctggagttcttcctcatggtcctgctgatccccgagcccgaccgccagcggaccccgcaggacaaccagctcgcgtacgtggtgatcgggctgctgttcatgatcctcacggtcgccgccaacgagatgggcctgctggagaccaccaagaaggacctcgggatcggccacgtggccgtggagaaccaccaccacgccgcgatgctggacgtcgacctgcaccccgcctccgcctggaccctctacgccgtggccacgaccatcatcacccccatgatgcgccacaccatcgagaacacgaccgcgaacatcagcctgaccgccatcgccaaccaggccgcgatcctgatggggctcgacaagggctggccgatctccaagatggacatcggcgtgcccctgctggccctcgggtgctacagccaggtcaaccccctgaccctgacggccgccgtgctcatgctggtggcccactacgcgatcatcggccccgggctgcaggccaaggccacccgggaggcccagaagcgcaccgccgcgggcatcatgaagaacccgaccgtcgacgggatcgtggccatcgacctcgaccccgtggtctacgacgccaagttcgagaagcagctgggccagatcatgctgctcatcctgtgcacgtcccagatcctgctcatgcgcaccacctgggccctgtgcgagagcatcaccctggccacgggccccctcaccaccctgtgggaggggtcccccggcaagttctggaacaccacgatcgcggtgagcatggccaacatcttccgggggagctacctggccggcgccggcctcgcgttctccctgatgaagtccctcgggggcgggcgccgggggaccggggcccagggcgagaccctcggcgagaagtggaagcgccagctgaaccagctgtccaagagcgagttcaacacctacaagcggtccgggatcatggaggtggaccgcagcgaggccaaggagggcctcaagcgcggggagacgaccaagcacgccgtctcccgcggcaccgccaagctgcggtggttcgtggagcgcaacctggtgaagccggaggggaaggtcatcgacctcggctgcggccgcggcgggtggagctactactgcgcggggctgaagaaggtgaccgaggtgaaggggtacacgaagggcggccccggccacgaggagcccatccccatggccacctacgggtggaacctggtcaagctgcactccggcaaggacgtgttcttcatcccgcccgagaagtgcgacaccctcctgtgcgacatcggggagagctcccccaaccccaccatcgaggagggccgcacgctgcgggtgctcaagatggtcgagccgtggctgcgcgggaaccagttctgcatcaagatcctgaacccctacatgcccagcgtggtggagaccctcgagcagatgcagcggaagcacggcggcatgctggtccgcaaccccctgtcccggaacagcacccacgagatgtactgggtgtcctgcgggaccggcaacatcgtgagcgccgtcaacatgacctcccgcatgctcctgaaccggttcacgatggcccaccgcaagccgacctacgagcgcgacgtggacctgggggccggcacccggcacgtggcggtcgagcccgaggtggccaacctcgacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctgaccaagccgtgggacgtgatccccatggtgacccagatcgccatgaccgacacgacccccttcggccagcagcgggtcttcaaggagaaggtggacacccgcacccccaaggcgaagcgggggacggcccagatcatggaggtgaccgccaagtggctctggggcttcctgtcccgcaacaagaagccgcggatctgcacccgcgaggagttcacccggaaggtccgcagcaacgccgcgatcggcgccgtgttcgtggacgagaaccagtggaactccgccaaggaggccgtcgaggacgagcggttctgggacctggtgcaccgcgagcgggagctccacaagcaggggaagtgcgccacgtgcgtgtacaacatgatgggcaagcgcgagaagaagctgggggagttcggcaaggcgaaggggagccgggccatctggtacatgtggctgggcgcccgcttcctcgagttcgaggccctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgcgggctgggacacccggatcaccgaggacgacctccagaacgaggccaagatcacggacatcatggagcccgagcacgccctgctggccaagtccatcttcaagctcacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcgcagctgatccgccagatggagagcgaggggatcttctcccccagcgagctcgagacccccaacctggccggccgggtgctggactggctcgagaagcacggggtggagcgcctgaagcggatggccatctccggcgacgactgcgtcgtgaagcccatcgacgaccgcttcgccaccgccctgacggcgctcaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctggtcgggcgcgcccgggtgtcccagggcgccgggtggagcctccgcgagaccgcctgcctgggcaagtcctacgcgcagatgtggcagctgatgtacttccaccggcgcgacctccggctggccgccaacgccatctgcagcgccgtgccggtcgactgggtgcccacctcccgcaccacgtggagcatccacgcgcaccaccagtggatgaccaccgaggacatgctgtccgtgtggaaccgggtctggatcgaggagaacccctggatggaggacaagacccacatcagctcctggggcgacgtgccctacctcggcaagcgcgaggaccagtggtgcggcagcctgatcgggctgacggcccgggccacctgggccaccaacatccaggtggccatcaaccaggtccgccgcctcatcggcaacgagaactacctggactacatgacctccatgaagcggttcaagaacgagagcgacccggagggggcgctgtggtga

SEQ ID NO: 8749 - RNA, 9879 nt, synthetic construct
  misc_feature 1..9879: note = derived and/or modified CDS sequence (opt1) from DENV-1__EU482816__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgtgatggtgcaggccgacagcgggtgcgtcatcaactggaagggccgggagctgaagtgcgggagcggcatcttcgtgacgaacgaggtgcacacctggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagttcaccgtggtggtcggggacgtggcgggcatcctggcccaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgcgaacgcctccgaccgcatggggatgggcaccacctacctcgccctgatggccaccttcaagatgcgcccgatgttcgccgtggggctcctgttccggcgcctgacgagccgggaggtgctgctcctgaccatcgggctgtccctcgtcgcgagcgtggagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcctggaagaccatggcgatggtcctgtccatcgtgagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcgtgctacgtcatctccgggagctccgccgacctgagcctggagaaggccgccgaggtgtcctgggaggaggaggccgagcacagcggcgcgtcccacaacatcctcgtggaggtccaggacgacgggaccatgaagatcaaggacgaggagcgggacgacaccctgaccatcctgctcaaggccaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgcggtcctgatgtaccaggggaagcgcctcgagccctcctgggccagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgcgctcgacttcaagcccgggacgagcggcagccccatcgtgaaccgcgaggggaagatcgtgggcctgtacggcaacggggtcgtgaccacctccggcacctacgtgagcgccatcgcccaggccaaggcgtcccaggaggggcccctgccggagatcgaggacgaggtcttccggaagcgcaacctcacgatcatggacctgcaccccggcagcgggaagacccggcgctacctgcccgccatcgtgcgggaggccatcaagcgcaagctccggaccctgatcctggccccgacccgcgtggtcgcctccgagatggcggaggccctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgacggtcgcctccgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctcttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtccccctgctcgccctggggtgctacagccaggtgaaccccctgaccctcacggcggccgtgctgatgctggtcgcccactacgccatcatcggccccgggctccaggccaaggcgacccgggaggcccagaagcgcaccgccgccggcatcatgaagaacccgaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagccggaggggaaggtgatcgacctgggctgcggccgcggcgggtggagctactactgcgccgggctgaagaaggtgaccgaggtcaaggggtacacgaagggcgggcccggccacgaggagcccatccccatggccacctacgggtggaacctggtgaagctccactccggcaaggacgtgttcttcaccccgcccgagaagtgcgacaccctgctgtgcgacatcggggagagctcccccaaccccacgatcgaggagggccgcaccctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacgtcccgcatgctgctgaaccggttcaccatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacgtggcactacgacgaggacaacccctacaagacctgggcgtaccacgggtcctacgaggtcaagcccagcggcagcgcctccagcatggtgaacggggtcgtgaagctgctcaccaagccgtgggacgtgatccccatggtcacccagatcgccatgacggacaccacccccttcggccagcagcgggtgttcaaggagaaggtggacacccgcacgcccaaggccaagcgggggaccgcccagatcatggaggtcaccgcgaagtggctgtggggcttcctgtcccgcaacaagaagccgcggatctgcacccgcgaggagttcacgcggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgcgacctgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggccaagatcaccgacatcatggagcccgagcacgcgctgctcgccaagtccatcttcaagctgacctaccagaacaaggtggtccgcgtgcagcggccggccaagaacgggaccgtgatggacgtcatcagccgccgcgaccagcggggctccggccaggtgggcacgtacggcctgaacaccttcaccaacatggaggcccagctcatccgccagatggagagcgaggggatcttctcccccagcgagctggagacccccaacctggccggccgggtgctcgactggctggagaagcacggggtcgagcgcctgaagcggatggcgatctccggcgacgactgcgtggtgaagcccatcgacgaccgcttcgccacggccctcaccgccctgaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctcgtggggcgcgcccgggtgtcccagggcgcggggtggagcctgcgcgagaccgcctgcctgggcaagtcctacgcccagatgtggcagctcatgtacttccaccggcgcgacctgcggctggccgcgaacgccatctgcagcgccgtcccggtggactgggtgcccacctcccgcacgacctggagcatccacgcccaccaccagtggatgaccaccgaggacatgctctccgtctggaaccgggtgtggatcgaggagaacccctggatggaggacaagacgcacatcagctcctggggcgacgtgccctacctgggcaagcgcgaggaccagtggtgcggcagcctgatcgggctcaccgcccgggcgacctgggccaccaacatccaggtcgccatcaaccaggtgcgccgcctgatcggcaacgagaactacctggactacatgacctccatgaagcggttcaagaacgagagcgacccggagggggccctctggtga

SEQ ID NO: 8750 - RNA, 9879 nt, synthetic construct
  misc_feature 1..9879: note = derived and/or modified CDS sequence (opt1) from DENV-1__EU482821__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcaaccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgccgtgctgcggaagctctgcatcgaggcgaagatcagcaacaccacgaccgactcccgctgcccgacccagggcgaggccaccctggtggaggagcaggacgccaacttcgtctgccggcgcacgttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgaccgtccacacgggcgaccagcaccaggtggggaacgagagcaccgagcacggcaccaccgccaccatcacgccccaggcgcccaccaccgagatccagctcaccgactacggggccctgacgctggactgcagcccccggaccggcctcgacttcaacgagatggtcctgctgaccatgaaggagaagtcctggctcgtgcacaagcagtggttcctggacctgcccctcccctggacctccggggccagcacgagccaggagacctggaaccggcaggacctgctggtgaccttcaagaccgcccacgccaagaagcaggaggtcgtggtgctcggctcccaggagggcgcgatgcacacggccctgaccggggccaccgagatccagaccagcggcacgaccaccatcttcgccgggcacctgaagtgccgcctcaagatggacaagctgaccctgaagggcatgtcctacgtcatgtgcacggggagcttcaagctcgagaaggaggtggccgagacccagcacggcaccgtgctggtccagatcaagtacgagggcaccgacgcgccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcgtgatcggcgccggcgagaaggcgctgaagctctcctggttcaagaaggggagctccatcggcaagatgttcgaggccacggcccgcggggcccggcgcatggccatcctgggcgacaccgcgtgggacttcgggagcatcggcggcgtgttcacctccgtcgggaagctggtgcaccagatcttcggcaccgcctacggggtcctcttcagcggcgtctcctggacgatgaagatcgggatcggcgtgctgctgacctggctcggcctgaacagccgctccaccagcctgtccatgacctgcatcgccgtggggctcgtcacgctgtacctgggcgtgatggtgcaggccgacagcgggtgcgtcatcaactggaagggccgggagctcaagtgcgggtccggcatcttcgtgaccaacgaggtgcacacctggaccgagcagtacaagttccaggccgacagcccgaagcgcctgagcgcggccatcggcaaggcctgggaggagggggtctgcggcatccggtccgccacccgcctggagaacatcatgtggaagcagatcagcaacgagctcaaccacatcctgctggagaacgacatgaagttcacggtggtggtcggggacgtggccggcatcctcgcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggactcctacacccaggtgtgcgaccaccgcctcatgagcgcggccatcaaggactccaaggccgtgcacgccgacatgggctactggatcgagagcgagaagaacgagacctggaagctggcccgggcgtccttcatcgaggtcaagacgtgcatctggcccaagagccacaccctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcacgaccgtggtcgtggacgagcactgcggcaaccgggggccgagcctgcgcaccaccacggtgaccggcaagatcatccacgagtggtgctgccggtcctgcaccctgccgcccctccgcttccgcggggaggacggctgctggtacgggatggagatccgccccgtcaaggagaaggaggagaacctggtcaagagcatggtgtccgccggcagcggcgaggtcgacagcttctccctcgggctgctgtgcatcagcatcatgatcgaggaggtgatgcggtcccgctggagccggaagatgctcatgaccggcacgctggccgtgttcttcctgctcatcatggggcagctgacctggaacgacctgatccgcctctgcatcatggtcggcgccaacgcgtccgaccgcatggggatgggcaccacctacctggccctgatggccacgttcaagatgcggccgatgttcgccgtggggctcctgttccgccggctgaccagccgcgaggtgctcctgctgaccatcgggctctccctggtcgccagcgtggagctgcccaactccctcgaggagctgggcgacgggctggcgatgggcatcatgatcctcaagctgctgaccgacttccagagccaccagctctgggccacgctgctgtccctcaccttcatcaagaccaccttcagcctgcactacgcctggaagacgatggccatggtcctgtccatcgtgagcctcttccccctgtgcctgtccaccaccagccagaagaccacgtggctccccgtgctgctgggctccctcgggtgcaagccgctgaccatgttcctgatcgcggagaacaagatctggggccggcgcagctggcccctcaacgaggggatcatggccgtcggcatcgtgtccatcctgctgagcagcctcctgaagaacgacgtgcccctggccgggcccctcatcgccggcggcatgctgatcgcctgctacgtcatctccgggagctccgcggacctgagcctcgagaaggccgccgaggtgtcctgggaggaggaggccgagcacagcggcgcctcccacaacatcctggtggaggtccaggacgacgggaccatgaagatcaaggacgaggagcgggacgacaccctgaccatcctcctgaaggcgacgctgctcgccgtgagcggcgtgtacccgctgtccatccccgccaccctgttcgtctggtacttctggcagaagaagaagcagcgcagcggggtgctctgggacacccccagcccgcccgaggtgggccgggccgtcctggacgacggcatctaccgcatcatgcagcgggggctgctgggccgcagccaggtgggggtgggcgtcttccaggagaacgtgttccacaccatgtggcacgtgacgcgcggggccgtcctcatgtaccagggcaagcgcctggagccctcctgggcgagcgtgaagaaggacctgatctcctacggcgggggctggcggctccaggggagctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcacctccgggagccccatcgtgaaccgcgagggcaagatcgtgggcctgtacgggaacggcgtcgtgaccacctccgggacgtacgtgagcgcgatcgcccaggccaaggccagccaggagggcccgctccccgagatcgaggacgaggtcttccggaagcgcaacctgaccatcatggacctgcaccccgggtccggcaagacccggcgctacctcccggcgatcgtgcgggaggccatcaagcgcaagctgcgcaccctgatcctcgcccccacgcgggtggtcgccagcgagatggccgaggcgctgaagggcatgcccatccgctaccagaccaccgccgtgaagtccgagcacaccgggaaggagatcgtggacctgatgtgccacgccacgttcaccatgcggctcctgagccccgtccgcgtgccgaactacaacatgatcatcatggacgaggcccacttcaccgacccctccagcatcgccgcgcggggctacatctccacccgcgtggggatgggcgaggccgccgccatcttcatgacggccacgccgcccgggagcgtcgaggcgttcccgcagtccaacgccgtgatccaggacgaggagcgggacatccccgagcgcagctggaactccggctacgagtggatcaccgacttccccggcaagaccgtgtggttcgtccccagcatcaagtccgggaacgacatcgccaactgcctgcggaagaacggcaagcgcgtgatccagctcagccggaagacgttcgacaccgagtaccagaagaccaagaacaacgactgggactacgtggtcaccacggacatctccgagatgggggccaacttccgcgcggaccgggtgatcgacccgcgccggtgcctgaagcccgtgatcctgaaggacggccccgagcgcgtcatcctcgccgggcccatgccggtgaccgtcgccagcgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctacagcgaccccctcgccctgcgggagttcaaggagttcgccgcggggcgccggtccgtcagcggcgacctgatcctcgagatcggcaagctgccgcagcacctgacccagcgcgcccagaacgccctcgacaacctggtgatgctgcacaactccgagcagggcgggcgggcctaccgccacgcgatggaggagctccccgacacgatcgagaccctgatgctgctcgccctgatcgccgtgctgaccgggggcgtcaccctcttcttcctgagcgggcggggcctgggcaagacctccatcgggctcctgtgcgtgatggccagctccgtgctgctctggatggccagcgtcgagccccactggatcgcggcctccatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgccagcgcctggacgctgtacgcggtggccaccaccatcatcaccccgatgatgcgccacacgatcgagaacaccaccgccaacatctccctcaccgccatcgccaaccaggcggccatcctgatgggcctggacaagggctggcccatcagcaagatggacatcggggtccccctcctggccctgggctgctactcccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcaccagccagatcctgctgatgcgcaccacctgggcgctctgcgagtccatcacgctggccaccgggcccctgaccaccctctgggagggcagcccggggaagttctggaacacgaccatcgccgtgtccatggccaacatcttccggggcagctacctggccggcgcggggctggccttctccctcatgaagtccctgggcgggggccgccgggggaccggcgcccagggcgagaccctgggggagaagtggaagcgccagctcaaccagctgagcaagtccgagttcaacacgtacaagcggagcggcatcatggaggtcgaccgctccgaggccaaggaggggctgaagcggggcgagaccaccaagcacgcggtgagccgcgggaccgccaagctccggtggttcgtggagcgcaacctggtcaagcccgagggcaaggtgatcgacctgggctgcgggcggggcgggtggtcctactactgcgccggcctgaagaaggtgacggaggtcaaggggtacaccaagggcggccccgggcacgaggagcccatcccgatggccacctacggctggaacctcgtgaagctgcacagcgggaaggacgtgttcttcatcccgcccgagaagtgcgacaccctgctctgcgacatcggcgagtccagccccaacccgacgatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacccacgagatgtactgggtgagctgcggcaccgggaacatcgtctccgccgtgaacatgacgagccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagtccacgtggcactacgacgaggacaacccctacaagacctgggcctaccacggcagctacgaggtcaagccgtccgggagcgcgtccagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctcagccgcaacaagaagccccggatctgcacccgcgaggagttcacgcggaaggtgcgctccaacgcggccatcggggccgtgttcgtcgacgagaaccagtggaacagcgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaacatccccggcggcaacatgtacgccgacgacaccgccgggtgggacacccggatcacggaggacgacctgcagaacgaggcccgcatcaccgacatcatggagccggagcacgccctcctggccaagagcatcttcaagctgacctaccagaacaaggtggtccgcgtgcagcggcccgccaagaacggcaccgtgatggacgtcatctcccgccgggaccagcgcgggagcggccaggtgggcacgtacgggctcaacaccttcaccaacatggaggcccagctgatccggcagatggagtccgagggcatcttcagcccctccgagctggagacccccaacctcgccgagcgcgtgctggactggctggagaagtacggggtcgagcggctcaagcgcatggccatcagcggcgacgactgcgtggtgaagccgatcgacgaccggttcgcgacggccctgaccgccctgaacgacatggggaaggtccgcaaggacatcccccagtgggagccctccaagggctggaacgactggcagcaggtccccttctgcagccaccacttccaccagctcatcatgaaggacggccgggagatcgtggtcccgtgccgcaaccaggacgagctggtggggcgggcccgcgtgtcccagggcgccgggtggagcctgcgggagaccgcgtgcctcggcaagagctacgcccagatgtggcagctgatgtacttccaccgccgggacctgcgcctcgccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctgggcaagcgcgaggaccagtggtgcggctccctcatcgggctgaccgcccgggccacctgggcgaccaacatccaggtggccatcaaccaggtccgccggctgatcggcaacgagaactacctcgactacatgaccagcatgaagcgcttcaagaacgagtccgaccccgagggggccctgtggtga

SEQ ID NO: 8751 - RNA, 9879 nt, synthetic construct
  misc_feature 1..9879: note = derived and/or modified CDS sequence (opt1) from DENV-1__EU482822__SS-prME
  source 1..9879: mol_type = other RNA
tccgtgaccatgctgctcatgctgatgcccaccgccctggccttccacctcaccacccggggcggggagccccacatgatcgtgaccaagcaggagcggggcaagtccctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccacggacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcgatcctgcggaagctctgcatcgaggccaagatcagcaacaccacgaccgactcccgctgccccacccagggcgaggccaccctgatggaggagcaggacgccaacttcgtgtgccggcgcacgttcgtggaccggggctgggggaacggctgcgggctgttcggcaaggggagcctcatcacgtgcgccaagttcaagtgcgtcaccaagctggagggcaagatcgtgcagtacgagaacctgaagtactccgtgatcgtcaccgtgcacacgggcgaccagcaccaggtggggaacgagagcaccgagcacggcaccaccgcgaccatcacgccccaggcccccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtcaccttcaagaccgcccacgcgaagaagcaggaggtggtggtcctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtggcggagacgcagcacggcaccgtcctggtgcagatcaagtacgagggcaccgacgccccctgcaagatccccttcagcacccaggacgagaagggggtgacgcagaacggccggctgatcaccgccaacccgatcgtcaccgacaaggagaagcccgtgaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtcttcaccagcatcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctggggctcctgtgcatctccatcatgatcgaggaggtgatgcgcagccggtggtcccgcaagatgctgatgaccggcaccctcgccgtcttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtgggcctcctgttccggcgcctgacgtcccgggaggtcctcctgctgaccatcgggctcagcctggtggcctccgtggagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtcctcagcatcgtgtccctgatccccctgtgcctcagcacgacctcccagaagaccacctggctgcccgtcctgctcggcagcctggggtgcaagccgctgacgatgttcctcatcgcggagaacaagatctggggccgcaagtcctggcccctgaacgaggggatcatggccgtgggcgtggtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccactccatcctggtggaggtgcaggacgacgggaccatgaagatcaaggacgaggagcgggacgacaccctcaccatcctgctgaaggcgaccctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggcgagcgtcaagaaggacctcatctcctacggcggcgggtggcggctgcagggcagctggaacacgggggaggaggtccaggtgatcgccgtcgagcccggcaagaaccccaagaacgtgcagaccgcccccgggaccttcaagacccccgagggcgaggtgggcgccatcgccctggacttcaagcccgggacgtccggcagccccatcgtcaaccgcgaggggaagatcgtgggcctctacggcaacggggtggtcaccaccagcggcacctacgtgtccgcgatcgcccaggccaaggccagccaggaggggccgctgcccgagatcgaggacgaggtgttccggaagcgcaacctgacgatcatggacctccaccccggctccgggaagacccggcgctacctgccggcgatcgtccgggaggccatcaagcgcaagctgcggaccctcatcctggcccccacccgcgtggtggccagcgagatggccgaggcgctgaagggcatgcccatccgctaccagacgaccgccgtcaagtccgagcacaccggcaaggagatcgtggacctcatgtgccacgccaccttcacgatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgaccgccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagaccttcgacacggagtaccagaagaccaagaacaacgactgggactacgtggtgaccaccgacatctccgagatgggcgccaacttccgcgcggaccgggtcatcgacccgcgccggtgcctgaagcccgtgatcctcaaggacgggcccgagcgcgtgatcctggccggccccatgccggtcacggtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccgcggcgaggcgcggaagaccttcgtcgagctgatgcgccgcggggacctgcccgtgtggctcagctacaaggtggccagcgagggcttccagtactccgaccgccggtggtgcttcgacggcgagcgcaacaaccaggtcctggaggagaacatggacgtggagatctggacgaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacaccatcgagacgctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcacggtcgccgccaacgagatgggcctgctggagaccaccaagaaggacctcgggatcggccacgtggcggtggagaaccaccaccacgccaccatgctggacgtcgacctgcaccccgccagcgcctggacgctctacgccgtggcgaccaccatcatcaccccgatgatgcgccacacgatcgagaacaccaccgccaacatctccctgaccgccatcgccaaccaggccgcgatcctgatggggctcgacaagggctggcccatcagcaagatggacatcggcgtgcccctgctggccctcgggtgctactcccaggtcaaccccctgacgctgaccgccgccgtgctcatgctggtggcgcactacgccatcatcggcccggggctgcaggccaaggccacccgggaggcccagaagcgcaccgcggccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggccctgtgcgagtccatcacgctggcgaccggccccctcaccaccctgtgggaggggagcccgggcaagttctggaacacgaccatcgccgtgtccatggccaacatcttccgggggagctacctggccggcgccggcctcgcgttcagcctgatgaagtccctcgggggcgggcgccgggggaccggggcccagggcgagaccctcggcgagaagtggaagcgccagctgaaccagctgagcaagtccgagttcaacatctacaagcggagcgggatcatggaggtggaccgctccgaggccaaggagggcctcaagcgcggggagacgacccgccacgccgtcagccggggcaccgcgaagctgcgctggttcgtggagcggaacctggtgaagcccgaggggaaggtcatcgacctgggctgcggccgcgggggctggtcctactactgcgccgggctcaagaaggtgaccgaggtgaagggctacacgaagggcgggcccggccacgaggagcccatcccgatggccacctacgggtggaacctggtcaagctgcacagcggcaaggacgtgttcttcacgccgcccgagaagtgcgacaccctcctgtgcgacatcggggagtccagccccaacccgacgatcgaggagggccggaccctgcgcgtgctcaagatggtcgagccctggctgcgggggaaccagttctgcatcaagatcctgaacccctacatgccctccgtggtggagaccctcgagcagatgcagcgcaagcacggcggcatgctggtccggaacccgctgagccgcaactccacccacgagatgtactgggtgagctgcgggaccggcaacatcgtgtccgccgtcaacatgacgagccggatgctcctgaaccgcttcaccatggcccaccgcaagcccacctacgagaaggacgtggacctgggggcgggcacccggcacgtggccgtcgagcccgaggtggccaacctcgacatcatcggccagcgcatcgagaacatcaagcacgagcacaagtccacgtggcactacgacgaggacaacccctacaagacctgggcctaccacgggagctacgaggtgaagccgtccggcagcgccagctccatggtcaacggggtggtcaagctgctgaccaagccctgggacgtgatccccatggtgacccagatcgcgatgacggacaccacccccttcggccagcagcgggtcttcaaggagaaggtggacacccgcacgccgaaggccaagcgggggaccgtgcagatcatggaggtcaccgcccgctggctctggggcttcctgagccggaacaagaagccccgcatctgcacccgggaggagttcacgcgcaaggtgcggtccaacgccgccatcggcgcggtgttcgtcgacgagaaccagtggaacagcgccaaggaggccgtggaggacgagcgcttctgggacctggtgaagaaggagcgggagctccacaagcaggggaagtgcgcgacctgcgtctacaacatgatgggcaagcgcgagaagaagctgggggagttcggcaaggcgaaggggtcccgggccatctggtacatgtggctgggcgcccgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgccgacgacaccgcgggctgggacacccggatcacggaggacgacctccagaacgaggccaagatcaccgacatcatggagccggagcacgccctgctggccaccagcatcttcaagctcacctaccagaacaaggtggtccgcgtgcagcggcccgccaagaacgggacggtgatggacgtcatctcccgccgcgaccagcggggcagcggccaggtgggcacctacggcctgaacaccttcaccaacatggaggcgcagctgatccgccagatggagtccgaggggatcttcctccccagcgagctggagacgcccaacctggccgagcgggtgctcgactggctggagaagtacggcgtcgagcgcctgaagcggatggccatctccggggacgactgcgtggtgaagccgatcgacgaccgcttcgccaccgccctcaccgcgctgaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctcgtgggccgcgcccgggtgagccagggggccggctggagcctgcgcgagaccgcctgcctggggaagtcctacgcccagatgtggcagctcatgtacttccaccggcgcgacctgcggctggcggccaacgccatctgcagcgccgtccccgtggactgggtgcccacgtcccgcaccacctggagcatccacgcgcaccaccagtggatgaccacggaggacatgctctccgtctggaaccgggtgtggatcgaggagaacccctggatggaggacaagacccacgtgagctcctggggcgacgtcccgtacctggggaagcgcgaggaccagtggtgcggcagcctgatcggcctcaccgcccgggccacctgggcctccaacatccaggtggccatcaaccaggtgcgccgcctgatcgggaacgagaactacctggactacatgaccagcatgaagcggttcaagaacgagggcgaccccgagggggcgctctggtga

SEQ ID NO: 8752 - RNA, 9879 nt, synthetic construct
  misc_feature 1..9879: note = derived and/or modified CDS sequence (opt1) from DENV-1__EU482476__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgggatgaagttcaccgtcgtggtgggcgacgtcgtggggatcctcgcgcagggcaagaagatgatccggccccagcccatggagcacaagtacagctggaagtcctggggcaaggccaagatcatcggggccgacgtgcagaacacgaccttcatcatcgacggccccaacaccccggagtgccccgacgaccagcgcgcctggaacatctgggaggtcgaggactacgggttcggcatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtcaaggagaaggaggagaacctggtgaagtccatggtgagcgccggcagcggggaggtcgactccttcagcctcggcctgctgtgcacctccatcatgatcgaggaggtgatgcgcagccggtggtcccgcaagatgctcatgaccgggacgctggccgtgttcctgctcctgatcatgggccagctgacctggaacgacctcatccggctgtgcatcatggtcggggccaacgcgagcgaccgcatgggcatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggggacggcctcgcgatgggcatcatgatcctgaagctgctcaccgacttccagtcccaccagctgtgggccacgctgctcagcctgaccttcatcaagaccaccctgtccctccactacgcctggaagacgatggccatggtcctgagcatcgtgtccctgttccccctctgcctgagcaccacctcccagaagaccacgtggctgcccgtgctcctggggagcctgggctgcaagccgctcaccatgttcctgatcgcggagaacaagatctgggggcgcaagtcctggcccctgaacgagggcatcatggccgtcggggtggtgagcatcctcctgagctccctgctcaagaacgacgtccccctggccggccccctgatcgccggcgggatgctcatcgcctgctacgtgatcagcggctccagcgcggacctgtccctggagaaggccgccgaggtgagctgggaggaggaggccgagcactccggggccagccacaacatcctcgtcgaggtgcaggacgacggcaccatgaagatcaaggacgaggagcgggacgacaccctgaccatcctgctcaaggcgacgctgctggccgtgtccggggtctacccgctcagcatccccgccaccctgttcgtgtggtacttctggcagaagaagaagcagcgctccggcgtgctgtgggacacccccagcccgcccgaggtcgagcgggccgtgctggacgacggcatctaccgcatcatgcagcgggggctcctgggccgctcccaggtgggggtcggcgtgttccaggagaacgtgttccacaccatgtggcacgtcacgcgcggggccgtgctgatgtaccagggcaagcgcctcgagcccagctgggcgtccgtgaagaaggacctgatcagctacggcgggggctggcggctgcaggggtcctggaacaccggcgaggaggtccaggtgatcgccgtggagcccgggaagaaccccaagaacgtccagaccgcccccggcaccttcaagacgcccgagggcgaggtgggggccatcgccctcgacttcaagcccggcaccagcgggtcccccatcgtgaaccgcgagggcaagatcgtcggcctgtacgggaacggcgtggtgaccaccagcgggacgtacgtcagcgcgatcgcccaggccaaggcctcccaggagggcccgctgcccgagatcgaggacgaggtgttccggaagcgcaacctcaccatcatggacctgcaccccgggagcggcaagacccggcgctacctgccggcgatcgtgcgggaggccatcaagcgcaagctccggaccctgatcctggcccccacgcgcgtcgtggcctccgagatggccgaggcgctcaagggcatgcccatccgctaccagaccaccgccgtcaagagcgagcacaccgggaaggagatcgtcgacctgatgtgccacgccacgttcaccatgcggctgctctcccccgtgcgcgtgccgaactacaacatgatcatcatggacgaggcccacttcaccgaccccagctccatcgccgcgcggggctacatcagcacccgcgtcgggatgggcgaggccgccgccatcttcatgacggccacgccgcccgggtccgtggaggcgttcccgcagagcaacgccgtgatccaggacgaggagcgggacatccccgagcgctcctggaacagcggctacgagtggatcaccgacttccccggcaagaccgtctggttcgtgccctccatcaagagcgggaacgacatcgccaactgcctgcggaagaacggcaagcgcgtgatccagctgtcccggaagacgttcgacaccgagtaccagaagaccaagaacaacgactgggactacgtcgtgaccacggacatcagcgagatgggggccaacttccgcgcggaccgggtgatcgacccgcgccggtgcctcaagcccgtcatcctgaaggacggccccgagcgcgtgatcctggccgggcccatgccggtcaccgtggcctccgccgcccagcggcgcggccggatcggccgcaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgggagaagtccgccgccatcgacggcgagtaccgcctgcgcggggaggcgcggaagacgttcgtggagctgatgcgccggggcgacctccccgtctggctgtcctacaaggtggccagcgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgaccccctggccctccgggagttcaaggagttcgccgcggggcgccggagcgtgtccggcgacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccgggggcgtgaccctgttcttcctctccgggcggggcctgggcaagaccagcatcgggctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcggcctcctcttcatgatcctgaccgtggccgccaacgagatggggctgctcgagaccaccaagaaggacctgggcatcgggcacgtcgcggtggagaaccaccaccacgccacgatgctggacgtggacctccaccccgcctccgcctggaccctgtacgccgtcgcgaccaccatcatcacgccgatgatgcgccacaccatcgagaacaccaccgccaacatcagcctgacggccatcgccaaccaggccgcgatcctcatgggcctggacaagggctggcccatctccaagatggacatcggggtgcccctgctcgccctgggctgctacagccaggtgaaccccctgaccctcaccgccgccgtcctgatgctggtggcgcactacgccatcatcgggccgggcctccaggccaaggccacccgggaggcccagaagcgcacggcggccgggatcatgaagaaccccaccgtggacggcatcgtcgccatcgacctggaccccgtggtgtacgacgccaagttcgagaagcagctgggccagatcatgctcctgatcctgtgcacctcccagatcctcctgatgcgcaccacgtgggccctgtgcgagagcatcaccctcgcgaccgggcccctgaccacgctgtgggagggctccccggggaagttctggaacaccaccatcgccgtcagcatggccaacatcttccggggctcctacctcgccggcgccgggctggcgttcagcctgatgaagtccctcggcgggggccgccgggggaccggcgcccagggcgagacgctgggggagaagtggaagcgccagctgaaccagctctccaagagcgagttcaacatctacaagcggtccggcatcatggaggtggaccgcagcgaggccaaggaggggctgaagcggggcgagaccacccgccacgccgtgtcccgggggaccgcgaagctgcgctggttcgtcgagcggaacctggtgaagcccgagggcaaggtgatcgacctcggctgcgggcgcggcgggtggagctactactgcgccggcctgaagaaggtcacggaggtgaaggggtacaccaagggcggccccgggcacgaggagcccatcccgatggccacctacggctggaacctggtgaagctccactccgggaaggacgtcttcttcacgccgcccgagaagtgcgacacgctgctgtgcgacatcggcgagagctcccccaacccgaccatcgaggaggggcggaccctccgcgtgctgaagatggtggagccctggctgcggggcaaccagttctgcatcaagatcctcaacccctacatgcccagcgtcgtggagaccctggagcagatgcagcgcaagcacggcgggatgctggtgcggaacccgctctcccgcaacagcacccacgagatgtactgggtctcctgcggcacggggaacatcgtgagcgccgtgaacatgacctcccggatgctgctgaaccgcttcaccatggcccaccgcaagcccacctacgagcgggacgtcgacctcggcgcgggcacgcgccacgtggccgtggagcccgaggtcgccaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtgaagctgctcaccaagccctgggacgtcatccccatggtgacgcagatcgcgatgaccgacaccacccccttcgggcagcagcgcgtgttcaaggagaaggtcgacacgcggaccccgaaggccaagcgcggcaccgcccagatcatggaggtgaccgcccggtggctgtggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctcgtccagaaggagcgcgagctgcacaagcagggcaagtgcgcgacctgcgtgtacaacatgatggggaagcgggagaagaagctgggcgagttcgggaaggccaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatccccggcggcaacatgtacgcggacgacaccgccgggtgggacacgcgcatcaccgaggacgacctgcagaacgaggccaagatcaccgacatcatggagccggagcacgccctgctcgccacctccatcttcaagctgacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatggaggcccagctcatccggcagatggagagcgagggcatcttcctgccctccgagctggagacccccaacctcgccgagcgcgtcctggactggctggagaagtacggggtggagcggctcaagcgcatggccatcagcggcgacgactgcgtggtcaagccgatcgacgaccggttcgccaccgcgctggccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagaccgcgtgcctcggcaagagctacgcccagatgtggcagctgatgtacttccaccgccgggacctgcgcctcgccgccaacgcgatctgctccgccgtgcccgtggactgggtccccacgagccggaccacctggtccatccacgcccaccaccagtggatgaccacggaggacatgctgagcgtgtggaaccgcgtgtggatcgaggagaacccctggatggaggacaagacccacgtctccagctggggcgacgtgccgtacctgggcaagcgggaggaccagtggtgcggctccctcatcgggctgaccgcccgcgccacctgggcgagcaacatccaggtggccatcaaccaggtccgccggctgatcggcaacgagaactacctcgactacatgacctccatgaagcgcttcaagaacgagggggaccccgagggcgccctgtggtga

SEQ ID NO: 8753 - RNA, 9879 nt, synthetic construct
  misc_feature 1..9879: note = derived and/or modified CDS sequence (opt1) from DENV-1__EU482477__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagttcaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcaacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgctcgccgtgggcctgctgttccggcgcctcaccagccgggaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatcaagacgacctacagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgcgaggggaagatcgtgggcctctacggcaacggggtcgtgacgacctccggcacctacgtgagcgccatcgcccaggccaaggcgtcccaggaggggcccctgccggagatcgagaacgaggtcttccggaagcgcaacctgaccatcatggacctccaccccggcagcgggaagacgcggcgctacctgcccgccatcgtgcgggaggccatcaagcgcaagctgcggaccctcatcctggccccgacccgcgtggtcgcctccgagatggcggaggccctgaagggcatgcccatccgctaccagaccacggccgtcaagagcgagcacaccggcaaggagatcgtggacctcatgtgccacgccaccttcaccatgcggctgctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctcaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgggagaagtccgccgcgatcgacggggagtaccgcctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtctccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagaccctgatgctcctggccctgatcgccgtgctcacgggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacgcgggaggcccagaagcgcaccgccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagaccacgaagcacgccgtgtcccgcggcaccgccaagctgcggtggttcgtggagcgcaacctggtcaagccggaggggaaggtgatcgacctgggctgcggccgcggcgggtggagctactactgcgccgggctcaagaaggtgaccgaggtcaaggggtacaccaagggcgggcccggccacgaggagcccatccccatggccacgtacgggtggaacctggtgaagctgcactccggcaaggacgtgttcttcatcccgcccgagaagtgcgacaccctcctgtgcgacatcggggagagctcccccaaccccaccatcgaggagggccgcaccctgcgggtcctcaagatggtggagccgtggctgcgcgggaaccagttctgcatcaagatcctgaacccctacatgcccagcgtggtcgagacgctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccggttcaccatggcccaccgcaagccgacgtacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggccaagtccatcttcaagctcacgtaccagaacaaggtggtccgcgtgcagcggccggccaagaacgggaccgtgatggacgtcatcagccgccgcgaccagcggggctccggccaggtgggcacctacggcctgaacaccttcacgaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagacggcctgcctgggcaagtcctacgcccagatgtggcagctgatgtacttccaccggcgcgacctccggctggccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacatcagctcctggggcgacgtgccctacctcggcaagcgcgaggaccagtggtgcggcagcctgatcgggctgaccgcccgggcgacgtgggccaccaacatccaggtcgccatcaaccaggtgcgccgcctcatcggcaacgagaactacctggactacatgacctccatgaagcggttcaagaacgagagcgacccggagggggccctgtggtga

SEQ ID NO: 8754 - RNA, 9879 nt, synthetic construct
  misc_feature 1..9879: note = derived and/or modified CDS sequence (opt1) from DENV-1__EU482478__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcccacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtccgggaggccatcaagcgcaagctgcgcaccctcatcctggcccccacgcgggtggtggccagcgagatggccgaggcgctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgccaacttccgcgcggaccgggtcatcgacccgcgccggtgcctgaagcccgtgatcctcaaggacgggcccgagcgcgtgatcctggccggccccatgccggtcaccgtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgacgagccgcatgctcctgaaccgcttcaccatggcgcaccggaagcccacctacgagcgcgacgtggacctgggggccggcacccggcacgtggccgtcgagcccgagatcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgagccgcaacaagaagccccggatctgcacccgcgaggagttcacgcggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcgtgcctgggcaagagctacgcccagatgtggcagctgatgtacttccaccgccgggacctccgcctggccgccaacgcgatctgctccgccgtgcccgtggactggatccccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtcgccatcaaccaggtgcgccggctcatcgggaacgagaactacctggactacatgaccagcatgaagcgcttcaagaacgagggcgaccccgagggggccctgtggtga

SEQ ID NO: 8755 - RNA, 9879 nt, synthetic construct
  misc_feature 1..9879: note = derived and/or modified CDS sequence (opt1) from DENV-1__EU482479__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatctgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcgtggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcgggctcctgttcatgatcctgaccgtggccgccaacgagatgggcctcctggagaccaccaagaaggacctggggatcggccacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtccccctcctggccctggggtgctacagccaggtgaaccccctcacgctgaccgccgcggtgctgatgctcgtcgcccactacgccatcatcggcccggggctgcaggccaaggccacccgcgaggcgcagaagcggaccgccgccggcatcatgaagaaccccacggtggacgggatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtcgaccgcagcgaggccaaggagggcctgaagcgcggggagaccaccaagcacgcggtgtcccgcggcaccgccaagctccggtggttcgtggagcgcaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgacgatcgaggagggccgcaccctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgccgtgaacatgacgtcccgcatgctgctcaaccgcttcaccatggcgcaccggaagcccacctacgagaaggacgtggacctgggggccggcacccgccacgtcgccgtggagcccgaggtggccaacctggacatcatcggccagcggatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctcctgaccaagccctgggacgtgatccccatggtcacccagatcgccatgacggacaccacccccttcggccagcagcgcgtgttcaaggagaaggtggacacccggacgccgaaggccaagcgcgggaccgcccagatcatggaggtcaccgccaagtggctgtggggcttcctctcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgccatctggtacatgtggctgggcgcccggttcctggagttcgaggcgctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcacggaggacgacctgcagaacgaggcccggatcaccgacatcatggagccggagcacgccctcctggcgaagtccatcttcaagctgacctaccagaacaaggtggtccgcgtgcagcgccccgccaagaacgggaccgtgatggacgtcatcagccggcgcgaccagcggggctccggccaggtggggacgtacggcctcaacaccttcaccaacatggaggcccagctgatccgccagatggagagcgaggggatcttctcccccagcgagctggagacccccaacctcgccgagcgggtgctggactggctgaagaagtacggcgtcgagcgcctcaagcggatggccatctccggggacgactgcgtggtgaagccgatcgacgaccgcttcgcgacggccctgaccgccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcacgacctggagcatccacgcccaccaccagtggatgaccaccgaggacatgctgtccgtgtggaaccgggtctggatcgaggagaacccctggatggaggacaagacgcacatcagctcctggggcgacgtgccgtacctggggaagcgcgaggaccagtggtgcggcagcctcatcggcctgaccgcccgcgccacctgggcgaccaacatccaggtggccatcaaccaggtccggcgcctgatcgggaacgagaactacctcgactacatgacctccatgaagcggttcaagaacgagggcgaccccgagggggccctgtggtga

SEQ ID NO: 8756 - RNA, 9879 nt, synthetic construct
  misc_feature 1..9879: note = derived and/or modified CDS sequence (opt1) from DENV-1__EU482480__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcaccgaggccgagcccgacgacgtggactgctggtgcaacgccaccgacacgtgggtcacctacgggacctgcacccagatcggcgagcaccggcgcgacaagcggagcgtggccctggcgccccacgtgggcctcgggctggagacgcggaccgagacctggatgtccagcgagggcgcctggaagcagatccagcgggtcgagacctgggccctgcgccaccccgggttcacggtgatcgccctcttcctggcgcacgccatcggcacctccatcacccagaaggggatcatcttcatcctgctcatgctggccacccccagcatggccatgcggtgcgtgggcatcggctcccgcgacttcgtcgaggggctgagcggcgccacgtgggtggacgtggtcctcgagcacgggtcctgcgtgaccaccatggcgaaggacaagcccaccctggacatcgagctgctcaagacggaggtgaccaaccccgccgtcctgcggaagctgtgcatcgaggccaagatcagcaacaccaccacggactcccgctgcccgacccagggcgaggccaccctcgtggaggagcaggacgccaacttcgtgtgccggcgcaccttcgtcgaccggggctgggggaacggctgcgggctgttcggcaaggggagcctgatcacgtgcgcgaagttcaagtgcgtgaccaagctcgagggcaagatcgtgcagtacgagaacctgaagtactccgtcatcgtgaccgtgcacaccggcgaccagcaccaggtcgggaacgagagcacggagcacggcaccatcgccaccatcacgccccaggccccctccaccgagatccagctgacggactacggggccctcaccctggactgcagcccccgcaccggcctggacttcaacgagatggtgctcctgaccatgaaggagaagtcctggctggtccacaagcagtggttcctcgacctgccgctgccctggacgagcggggccagcacctcccaggagacctggaaccggcaggacctcctggtgaccttcaagacggcgcacgccaagaagcaggaggtggtcgtgctgggcagccaggagggcgccatgcacaccgccctcaccggggccaccgagatccagacgtccggcaccaccaccatcttcgcggggcacctgaagtgccgcctgaagatggacaagctcacgctgaagggcatgagctacgtgatgtgcaccgggtccttcaagctggagaaggaggtcgccgagacccagcacggcaccgtgctcgtgcagatcaagtacgagggcacggacgccccctgcaagatccccttcagcacccaggacgagaagggggtcacccagaacggccggctgatcaccgccaacccgatcgtgacggacaaggagaagcccgtgaacatcgaggcggagccgcccttcggggagtcctacatcgtcatcggcgccggcgagaaggccctgaagctgagctggttcaagaaggggtccagcatcggcaagatgttcgaggccaccgcccgcggggcgcggcgcatggccatcctcggcgacaccgcctgggacttcgggtccatcggcggcgtgttcaccagcgtggggaagctggtccaccagatcttcggcacggcctacggggtgctgttctccggcgtgagctggaccatgaagatcgggatcggcgtcctcctgacctggctgggcctcaactcccgcagcacctccctgagcatgacgtgcatcgccgtggggctggtgaccctctacctgggcgtcatggtgcaggcggactccgggtgcgtgatcaactggaagggccgggagctgaagtgcgggagcggcatcttcgtcaccaacgaggtgcacacctggacggagcagtacaagttccaggccgacagcccgaagcgcctctccgccgccatcggcaaggcctgggaggagggggtgtgcggcatccggagcgcgacccgcctggagaacatcatgtggaagcagatctccaacgagctgaaccacatcctcctggagaacgacatgaagctgaccgtcgtggtgggggacgtcgccggcatcctcgcccaggggaagaagatgatccggccccagcccatggagtacaagtacagctggaagatctggggcaaggccaagatcatcggcgcggacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggactcctacacccaggtctgcgaccaccgcctcatgagcgccgccatcaaggactccaaggccgtgcacgcggacatgggctactggatcgagagcgagaagaacgagacgtggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtgtccgccggcagcggcgaggtggacagcttctccctcgggctgctgtgcatcagcatcatgatcgaggaggtcatgcgctcccggtggagccgcaagatgctcatgacgggcaccctggcggtgttcttcctgctcatcatggggcagctgacctggaacgacctgatccggctctgcatcatggtgggcgccaacgcctccgaccgcatggggatgggcaccacgtacctggccctgatggccaccttcaagatgcgcccgatgttcgcggtcggcctcctgttccggcgcctgaccagccgggaggtgctcctgctgaccatcgggctctccctggtggccagcgtcgagctgcccaactccctcgaggagctgggcgacgggctggccatgggcatcatgatcctcaagctgctgacggacttccagagccaccagctctgggccaccctgctgtccctcaccttcatccgcaccacgttcagcctgcactacgcgtggaagaccatggccatggtgctgtccatcgtcagcctcttccccctgtgcctgtccaccaccagccagaagacgacctggctccccgtgctgctgggctccctcgggtgcaagccgctgaccatgttcctgatcgccgagaacaagatctggggccggaagtcctggcccctcaacgaggggatcatggccgtgggcatcgtctccatcctgctgagcagcctcctgaagaacgacgtgcccctggccgggcccctcatcgcgggcggcatgctgatcgcctgctacgtgatctccgggagctccgccgacctgagcctcgagaaggccgccgaggtctcctgggaggaggaggcggagcacagcggcgcctcccacaacatcctggtggaggtgcaggacgacgggaccatgaagatcaaggacgaggagcgcgacgacacgctgaccatcctcctgaaggccaccctgctcgccgtcagcggcgtgtacccgctgtccatccccgccaccctgttcgtgtggtacttctggcagaagaagaagcagcggagcggggtcctctgggacacccccagcccgcccgaggtggagcgcgcggtgctggacgacggcatctaccggatcatgcagcgcggcctgctggggcggagccaggtcggcgtgggggtgttccaggagaacgtcttccacacgatgtggcacgtgacccgcggcgccgtgctcatgtaccaggggaagcggctggagccctcctgggccagcgtcaagaaggacctgatctcctacggcggcgggtggcgcctccagggcagctggaacaccggggaggaggtccaggtgatcgccgtcgagcccggcaagaaccccaagaacgtgcagaccgcccccgggacgttcaagacctccgagggcgaggtgggcgcgatcgccctggacttcaagcccgggaccagcggctcccccatcgtcaaccgggaggggaagatcgtgggcctgtacggcaacggggtggtcaccacgagcggcacctacgtgagcgccatcgcccaggcgaaggcctcccaggaggggcccctcccggagatcgaggacgaggtgttccgcaagcggaacctgaccatcatggacctgcaccccggcagcgggaagacccgccggtacctccccgccatcgtccgcgaggccatcaagcggcgcctgcgcacgctgatcctcgccccgacccgggtggtggcgtccgagatggccgaggccctgaagggcatgcccatccgctaccagaccaccgccgtcaagagcgagcacacgggcaaggagatcgtggacctgatgtgccacgccaccttcaccatgcggctcctgtcccccgtgcgcgtccccaactacaacatgatcatcatggacgaggcgcacttcaccgacccgagctccatcgccgcccgggggtacatcagcacgcgcgtgggcatgggggaggccgccgcgatcttcatgaccgccacgccgcccggctccgtggaggccttcccccagagcaacgccgtcatccaggacgaggagcgggacatcccggagcgctcctggaacagcgggtacgagtggatcaccgacttccccggcaagacggtgtggttcgtgccctccatcaagagcggcaacgacatcgcgaactgcctgcggaagaacgggaagcgcgtcatccagctctcccggaagaccttcgacaccgagtaccagaagaccaagaacaacgactgggactacgtggtgacgaccgacatcagcgagatgggcgccaacttccgcgccgaccgggtcatcgacccccgccggtgcctgaagccggtgatcctgaaggacgggcccgagcgcgtgatcctcgccggccccatgcccgtcaccgtggcctccgcggcccagcggcgcgggcggatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgcgagaagtccgcggccatcgacggggagtaccggctgcgcggcgaggcccggaagaccttcgtcgagctcatgcgccgcggggacctgccggtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgcgctgcgggagttcaaggagttcgccgccggccgccggagcgtgtccggggacctgatcctcgagatcggcaagctgccccagcacctgacgcagcgcgcccagaacgcgctcgacaacctggtcatgctgcacaacagcgagcagggcgggcgggcctaccgccacgccatggaggagctcccggacaccatcgagaccctgatgctgctcgccctgatcgccgtgctgaccggcggggtgaccctgttcttcctgtccggccgggggctgggcaagaccagcatcggcctcctgtgcgtcatggcgtccagcgtgctgctctggatggcctccgtggagccccactggatcgccgccagcatcatcctggagttcttcctgatggtcctcctgatccccgagcccgaccgccagcggaccccgcaggacaaccagctggcctacgtggtgatcgggctcctgttcatgatcctgaccgtcgcggccaacgagatgggcctcctggagaccacgaagaaggacctggggatcggccacgtggccgtggagaaccaccaccacgccgccatgctcgacgtcgacctgcaccccgcgtccgcctggaccctgtacgccgtggccaccaccatcatcacgcccatgatgcgccacaccatcgagaacaccaccgccaacatcagcctcacggcgatcgccaaccaggccgccatcctgatggggctggacaagggctggccgatctccaagatggacatcggcgtgcccctcctggcgctggggtgctacagccaggtcaaccccctcaccctgaccgccgccgtgctgatgctcgtggcccactacgccatcatcggccccgggctgcaggcgaaggccacccgcgaggcccagaagcggacggccgccggcatcatgaagaacccgaccgtcgacgggatcgtggcgatcgacctggaccccgtggtctacgacgccaagttcgagaagcagctcggccagatcatgctgctgatcctctgcacctcccagatcctgctgatgcgcaccacgtgggccctctgcgagagcatcaccctggccaccggccccctgaccacgctctgggaggggtcccccggcaagttctggaacaccaccatcgccgtgagcatggcgaacatcttccgggggtcctacctggccggcgccggcctggccttcagcctcatgaagtccctcgggggcgggcgccgggggaccggggcgcagggcgagacgctgggcgagaagtggaagcgccagctcaaccagctgtccaagagcgagttcaacacctacaagcggtccgggatcatggaggtggaccgcagcgaggccaaggagggcctgaagcgcggggagaccaccaagcacgccgtctcccgcggcacggccaagctccggtggttcgtggagcgcaacctggtgaagccggaggggaaggtcatcgacctgggctgcggccgcggcgggtggagctactactgcgccgggctgaagaaggtgaccgaggtgaaggggtacaccaagggcggccccggccacgaggagcccatccccatggcgacctacgggtggaacctcgtcaagctgcactccggcaaggacgtgttcttcatcccgcccgagaagtgcgacacgctgctctgcgacatcggggagagctcccccaaccccaccatcgaggagggccgcaccctgcgggtgctgaagatggtcgagccgtggctccgcgggaaccagttctgcatcaagatcctgaacccctacatgcccagcgtggtggagaccctggagcagatgcagcggaagcacggcggcatgctcgtccgcaaccccctgtcccggaacagcacgcacgagatgtactgggtgtcctgcgggaccggcaacatcgtgagcgccgtcaacatgacctcccgcatgctgctcaaccgcttcaccatggcccaccggaagccgacctacgagcgcgacgtggacctgggggccggcacgcggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagcccagcggctccgccagcagcatggtcaacggggtggtcaagctcctgaccaagccgtgggacgtgatccccatggtgacgcagatcgccatgaccgacaccacccccttcggccagcagcgggtcttcaaggagaaggtggacacgcgcacccccaaggccaagcgggggaccgcgcagatcatggaggtgaccgccaagtggctgtggggcttcctctcccgcaacaagaagccgcggatctgcacgcgcgaggagttcacccggaaggtccgcagcaacgccgccatcggcgcggtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacgcggatcaccgaggacgacctgcagaacgaggcgaagatcaccgacatcatggagcccgagcacgccctcctggccaagtccatcttcaagctgacctaccagaacaaggtggtgcgcgtccagcgcccggccaagaacgggacggtgatggacgtgatcagccggcgcgaccagcggggctccgggcaggtcggcacctacggcctcaacaccttcaccaacatggaggcccagctgatccgccagatggagagcgaggggatcttctcccccagcgagctggagacgcccaacctcgcgggccgggtgctggactggctggagaagcacggggtggagcgcctcaagcggatggccatctccggcgacgactgcgtcgtgaagcccatcgacgaccgcttcgccaccgccctgaccgccctgaacgacatggggaaggtgcggaaggacatcccgcagtgggagcccagcaagggctggaacgactggcagcaggtccccttctgctcccaccacttccaccagctcatcatgaaggacggccgcgagatcgtggtgccctgccggaaccaggacgagctggtcgggcgcgcgcgggtgagccagggcgccgggtggagcctgcgcgagaccgcctgcctcggcaagtcctacgcccagatgtggcagctgatgtacttccaccggcgcgacctgcggctcgcggccaacgccatctgcagcgccgtgccggtcgactgggtgcccacgtcccgcaccacctggagcatccacgcccaccaccagtggatgaccacggaggacatgctgtccgtgtggaaccgggtctggatcgaggagaacccctggatggaggacaagacccacgtgagctcctggggcgacgtgccctacctgggcaagcgcgaggaccagtggtgcggcagcctcatcgggctgaccgcgcgcgccacctgggccacgaacatccaggtcgccatcaaccaggtgcggcgcctgctcggcaacgagaactacctggactacatgacctccatgaagcggttcaagaacgagagcgacccggagggggccctgtggtga

SEQ ID NO: 8757 - RNA, 9879 nt, synthetic construct
  misc_feature 1..9879: note = derived and/or modified CDS sequence (opt1) from DENV-1__EU482481__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgctcccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccgtgggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcgcaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcctggaacatctgggaggtggaggactacggcttcgggatcttcaccacgaacatctggctgaagctgcgggacagctacacccaggtgtgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacacgctgtggagcaacggcgtgctcgagtccgagatgatcatccccaagatctacgggggcccgatcagccagcacaaccaccgccccgggtacttcacccagaccgccggcccctggcacctggggaagctggagctcgacttcgacctgtgcgagggcaccacggtcgtggtggacgagcactgcggcaaccgggggccgtccctgcgcaccaccaccgtcacgggcaagatcatccacgagtggtgctgccggagctgcaccctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacgtggaacgacctcatccggctgtgcatcatggtgggcgccaacgcgagcgaccgcatggggatgggcaccacctacctggccctcatggccaccttcaagatgcgcccgatgttcgccgtgggcctgctgttccggcgcctcacgtcccgggaggtcctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtgtccctgttccccctctgcctgagcacgacctcccagaagaccacctggctgcccgtcctcctgggcagcctggggtgcaagccgctcacgatgttcctgatcaccgagaacaagatctggggccgcaagtcctggcccctgaacgaggggatcatggcggtgggcgtggtcagcatcctcctgagctccctgctcaagaacgacgtgcccctggccgggcccctgatcgccggcggcatgctcatcgcctgctacgtgatcagcgggtccagcgccgacctgtccctggagaaggcggccgaggtcagctgggaggaggaggccgagcactccggcgccagccacaacatcctcgtggaggtgcaggacgacgggaccatgaagatcaaggacgaggagcgggacgacaccctgaccatcctgctcaaggccacgctgctggcggtctccggcgtgtacccgctcagcatccccgccaccctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacgcggggcgccgtgctgatgtaccaggggaagcgcctcgagcccagctgggcctccgtcaagaaggacctgatcagctacggcggcgggtggcggctgcagggctcctggaacaccggggaggaggtccaggtgatcgcggtcgagcccggcaagaaccccaagaacgtgcagaccgcccccgggaccttcaagacgcccgagggcgaggtgggcgccatcgccctcgacttcaagcccgggaccagcggctcccccatcgtcaaccgcgaggggaagatcgtgggcctgtacggcaacggggtggtcaccaccagcggcacgtacgtgagcgccatcgcgcaggccaaggcctcccaggaggggccgctgcccgagatcgaggacgaggtgttccggaagcgcaacctcaccatcatggacctgcaccccggcagcgggaagacccggcgctacctgccggccatcgtccgggaggcgatcaagcgcaagctccggaccctgatcctggcccccacgcgcgtggtggcctccgagatggccgaggccctcaagggcatgcccatccgctaccagaccaccgcggtcaagagcgagcacaccggcaaggagatcgtggacctgatgtgccacgccacgttcaccatgcggctgctctcccccgtgcgcgtcccgaactacaacatgatcatcatggacgaggcccacttcaccgaccccagctccatcgccgcccgggggtacatcagcacccgcgtgggcatgggggaggcggccgccatcttcatgacggccacgccgcccggctccgtggaggccttcccgcagagcaacgcggtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgccgaccgggtcatcgacccgcgccggtgcctcaagcccgtgatcctgaaggacgggcccgagcgcgtcatcctggcgggccccatgccggtgaccgtggcctccgccgcccagcggcgcgggcggatcggccgcaaccacaacaaggagggcgaccagtacatctacatggggcagcccctcaacaacgacgaggaccacgcccactggaccgaggcgaagatgctgctggacaacatcaacacccccgagggcatcatccccgccctcttcgagccggagcgggagaagtccgccgccatcgacggggagtaccgcctgcgcggcgaggcccggaagacgttcgtcgagctgatgcgccgcggggacctccccgtgtggctgtcctacaaggtggcgagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgccggccgccggagcgtgtccggggacctgatcagcgagatcggcaagctgccgcagcacctcacccagcgcgcgcagaacgccctggacaacctggtcatgctccacaactccgagcagggcgggcgggcctaccgccacgccatggaggagctgcccgacacgatcgagaccctgatgctcctggcgctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgccgcgtccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggccgtggagaaccaccaccacgcgacgatgctggacgtcgacctgcaccccgccagcgcctggaccctctacgccgtggccaccaccatcatcacgccgatgatgcgccacaccatcgagaacaccaccgcgaacatctccctgacggccatcgccaaccaggccgccatcctgatggggctcgacaagggctggcccatcagcaagatggacatcggcgtgcccctgctggcgctcgggtgctactcccaggtcaaccccctgaccctgaccgccgccgtgctcatgctggtggcccactacgcgatcatcggcccggggctgcaggccaaggccacccgggaggcccagaagcgcacggccgcgggcatcatgaagaaccccaccgtcgacgggatcatcgccatcgacctcgaccccgtggtgtacgacgccaagttcgagaagcagctgggccagatcatgctgctcatcctgtgcaccagccagatcctgctcatgcgcaccacgtgggccctgtgcgagtccatcaccctggccaccggccccctcaccacgctgtgggaggggagcccgggcaagttctggaacaccaccatcgcggtctccatggccaacatcttccgggggagctacctggccggcgccggcctcgccttcagcctgatgaagtccctcgggggcgggcgccgggggaccggggcgcagggcgagacgctcggcgagaagtggaagcgccagctgaaccagctgagcaagtccgagttcaacatctacaagcggagcgggatcatggaggtggaccgctccgaggccaaggagggcctcaagcgcggggagaccacccgccacgccgtgagccggggcaccgccaagctgcgctggttcgtcgagcggaacctggtgaagcccgaggggaaggtgatcgacctgggctgcggccgcgggggctggtcctactactgcgcggggctcaagaaggtcacggaggtgaagggctacaccaagggcgggcccggccacgaggagcccatcccgatggccacctacgggtggaacctggtgaagctgcacagcggcaaggacgtcttcttcacgccgcccgagaagtgcgacacgctcctgtgcgacatcggggagtccagccccaacccgaccatcgaggagggccggaccctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggacgggcaacatcgtgtccgccgtgaacatgaccagccggatgctcctgaaccgcttcaccatggcccaccgcaagcccacctacgagcgggacgtcgacctgggggccggcacgcgccacgtggcggtggagcccgaggtcgccaacctcgacatcatcggccagcggatcgagaacatcaagcacgagcacaagtccacctggcactacgacgaggacaacccctacaagacctgggcctaccacgggagctacgaggtgaagccgtccggcagcgccagctccatggtcaacggggtggtgaagctgctgaccaagccctgggacgtcatccccatggtgacgcagatcgccatgaccgacaccacccccttcggccagcagcgcgtgttcaaggagaaggtcgacacgcggaccccgaaggcgaagcgcgggaccgcccagatcatggaggtgaccgcccggtggctctggggcttcctgagccgcaacaagaagccccggatctgcacgcgcgaggagttcacccggaaggtgcgctccaacgccgccatcggcgcggtcttcgtggacgagaaccagtggaacagcgccaaggaggccgtggaggacgagcggttctgggacctggtccagaaggagcgcgagctccacaagcaggggaagtgcgcgacctgcgtgtacaacatgatgggcaagcgggagaagaagctgggggagttcggcaaggcgaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgccgacgacaccgcgggctgggacacgcgcatcaccgaggacgacctccagaacgaggccaagatcaccgacatcatggagccggagcacgccctgctggccaccagcatcttcaagctcacgtaccagaacaaggtcgtgcgggtgcagcgccccgccaagaacgggaccgtcatggacgtgatctcccgccgggaccagcgcggcagcggccaggtgggcacctacggcctgaacaccttcacgaacatggaggcgcagctgatccggcagatggagtccgaggggatcttcctccccagcgagctggagacccccaacctggccgagcgcgtcctcgactggctggagaagtacggcgtggagcggctgaagcgcatggccatctccggggacgactgcgtggtcaagccgatcgacgaccggttcgccaccgccctcaccgcgctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagacggcctgcctggggaagtcctacgcccagatgtggcagctcatgtacttccaccgccgggacctgcgcctggcggccaacgccatctgcagcgccgtgcccgtggactgggtccccacctcccggaccacctggagcatccacgcgcaccaccagtggatgacgaccgaggacatgctctccgtgtggaaccgcgtgtggatcgaggagaacccctggatggaggacaagacccacgtcagctcctggggcgacgtgccgtacctggggaagcgggaggaccagtggtgcggcagcctgatcggcctcaccgcccgcgccacctgggcctccaacatccaggtggccatcaaccaggtccgccggctgatcgggaacgagaactacctggactacatgacgagcatgaagcgcttcaagaacgagggcgaccccgagggggcgctctggtga

SEQ ID NO: 8758 - RNA, 9879 nt, synthetic construct
  misc_feature 1..9879: note = derived and/or modified CDS sequence (opt1) from DENV-1__EU482482__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccaagcgcgtgctggactggctcgagaagtacggcgtggagcggctgaagcgcatggccatctccggggacgactgcgtcgtgaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8759 - RNA, 9879 nt, synthetic construct
  misc_feature 1..9879: note = derived and/or modified CDS sequence (opt1) from DENV-1__EU482485__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaacatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccaccaagaacggcacggtgatggacgtcatcagccgccgggaccagcgcgggtccggccaggtgggcacctacgggctcaacaccttcaccaacatggaggcccagctgatccggcagatggagagcgagggcatcttctcccccagcgagctggagacgcccaacctcgccgagcgcgtgctggactggctggagaagtacggggtcgagcggctcaagcgcatggccatctccggcgacgactgcgtggtgaagccggtcgacgaccggttcgccaccgcgctgaccgccctgaacgacatggggaaggtgcgcaaggacatcccccagtgggagcccagcaagggctggaacgactggcagcaggtccccttctgctcccaccacttccaccagctcatcatgaaggacggccgggagatcgtcgtgccgtgccgcaaccaggacgagctggtggggcgggcccgcgtcagccagggcgccgggtggagcctgcgggagaccgcctgcctcggcaagtcctacgcgcagatgtggcagctgatgtacttccaccgccgggacctgcgcctcgccgccaacgccatctgcagcgcggtgcccgtggactggatccccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccgtacctgggcaagcgcgaggaccagtggtgcggcagcctcatcgggctgaccgcccgggccacctgggccaccaacatccaggtcgcgatcaaccaggtgcgccggctgatcggcaacgagaactacctcgactacatgacgtccatgaagcgcttcaagaacgagagcgaccccgagggggccctgtggtga

SEQ ID NO: 8760 - RNA, 9879 nt, synthetic construct
  misc_feature 1..9879: note = derived and/or modified CDS sequence (opt1) from DENV-1__EU482486__SS-prME
  source 1..9879: mol_type = other RNA
tccgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggctgttcaagctggagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctcaagctgagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctcgtgcaccagatcttcggcaccgcctacggggtcctgttctccggcgtgagctggaccatgaagatcgggatcggcgtgctgctcacctggctgggcctgaactcccgcagcacgtccctcagcatgacctgcatcgccgtcgggctggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggcgccagatctccaacgagctgaaccacatcctgctcgagaacgacatgaagttcaccgtggtcgtgggggacgtggtcggcatcctggcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctccgggacagctacacgcaggtctgcgaccaccgcctgatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggcccgatcagccagcacaactaccgccccgggtacttcacgcagaccgcgggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtgaaggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcaccctggccgtgttcttcctcctgatcatggggcagctgacctggaacgacctcatccggagctgcatcatggtgggcgccaacgcctccgaccgcatggggatgggcacgacctacctggcgctgatggccaccttcaagatgcgcccgatgttcgccgtcggcctcctgttccggcgcctgaccagccgggaggtgctcctgctgacgatcgggctctccctggtcgccagcgtggagctgcccaactccctcgaggagctgggcgacgggctggccatgggcatcatgatcctcaagctgctgaccgacttccagagctaccagctctgggcgaccctgctgtccctcaccttcatcaagacgaccttcagcctgcactacgcctggaagaccatggccatggtgctgtccatcgtcagcctcctgcccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgggacgacaccctcaccatcctgctgaaggccaccctcctggcggtcagcggcgtgtacccgctgtccatccccgccaccctcttcgtgtggtacttctggcagaagaagaagcagcgcagcggggtcctgtgggacacgcccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctctacggcaacggggtggtcacgaccagcggcacctacgtgtccgccatcgcgcaggccaaggccagccaggaggggccgctgcccgagatcgaggacgaggtgttccggaagcgcaacctgaccatcatggacctccaccccggctccgggaagacgcggcgctacctgccggccatcgtccgggaggcgatcaagcgcaagctgcggaccctcatcctggcccccacccgcgtggtggccagcgagatggccgaggccctgaagggcatgcccatccgctaccagaccacggcggtcaagtccgagcacaccggccgggagatcgtggacctcatgtgccacgccaccttcaccatgcgcctgctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcgtggaggccttcccgcagtccaacgcggtcatccaggacgaggagcgcgacatccccgagcggagctggaactccgggtacgagtggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccgcggcgctgcctgaagcccgtgatcctcaaggacgggcccgagcgggtcatcctggcgggccccatgccggtgaccgtggccagcgccgcccagcgccgggggcgcatcggccggaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgcgagaagtccgccgccatcgacggggagtaccgcctccggggcgaggcccgcaagaccttcgtcgagctgatgcggcgcggggacctgcccgtgtggctcagctacaaggtggcgagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgccgccggccggcgctccgtgagcggggacctcatcctggagatcggcaagctgccgcagcacctcacccagcgggcgcagaacgccctggacaacctggtcatgctccacaactccgagcagggcgggcgcgcctaccggcacgccatggaggagctgcccgacaccatcgagaccctgatgctcctggcgctgatcgccgtgctcacgggcggggtgaccctgttcttcctgagcggccgcgggctcggcaagacctccatcggcctgctgtgcgtcatggccagctccgccctcctgtggatggccagcgtggagccccactggatcgcggcctccatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagacgaccaagaaggacctcgggatcggccacgtcgcggtggagaaccaccaccacgccaccatgctggacgtggacctgcaccccgccagcgcctggaccctctacgccgtcgcgacgaccatcatcaccccgatgatgcggcacaccatcgagaacacgaccgccaacatctccctgaccgccatcgccaaccaggccgcgatcctgatggggctcgacaagggctggcccatcagcaagatggacatcggcgtgcccctgctggccctcgggtgctactcccaggtgaaccccctgaccctgacggccgccgtcctcatgctggtggcgcactacgccatcatcggcccggggctgcaggccaaggccacccgcgaggcccagaagcgcaccgcggccggcatcatgaagaaccccaccgtggacgggatcgtcgccatcgacctcgaccccgtggtgtacgacgccaagttcgagaagcagctgggccagatcatgctgctcatcctgtgcacgagccagatcctgctcatgcggaccacctgggccctgtgcgagtccatcaccctggcgacgggccccctcaccaccctgtgggaggggagcccgggcaagttctggaacaccacgatcgccgtctccatggccaacatcttccgcgggagctacctggccggcgccggcctcgcgttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtggaccggtccgaggccaaggagggcctccgccgcggggagacgaccaagcacgccgtgagccgcggcaccgcgaagctgcggtggttcgtcgagcgcaacctggtgaagcccgaggggaaggtgatcgacctgggctgcggccgcggcgggtggtcctactactgcgccgggctcaagaaggtcaccgaggtgaaggggtacacgaagggcggccccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgaccatcgaggagggccgcacgctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgaccagccgcatgctcctgaaccgcttcacgatggcccaccggaagcccacctacgagcgcgacgtcgacctgggggcgggcacccggcacgtggccgtggagcccgaggtcgccaacctcgacatcatcggccagcgcatcgagaacatcaagcacgagcacaagtccacctggcactacgacgaggacaacccctacaagacgtgggcctaccacgggagctacgaggtgaagccgtccggcagcgccagctccatggtcaacggggtggtgaagctgctgaccaagccctgggacgtcatccccatggtgacccagatcgcgatgaccgacacgacccccttcggccagcagcgggtgttcaaggagaaggtcgacacccgcaccccgaaggccaagcgggggacggcccagatcatggaggtgaccgcccgctggctctggggcttcctgagccggaacaagaagccccgcatctgcacccgggaggagttcacccgcaaggtgcggtccaacgccgcgatcggcgccgtcttcgtggacgagaaccagtggaacagcgccaaggaggccgtggaggacgagcgcttctgggacctggtccaccgggagcgcgagctccacaagcaggggaagtgcgcgacgtgcgtgtacaacatgatgggcaagcgggagaagaagctgggggagttcggcaaggccaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgcggacgacaccgccggctgggacacccgcatcaccgaggacgacctccagaacgaggccaagatcacggacatcatggagccggagcacgccctgctggccaccagcatcttcaagctcacctaccagaacaaggtcgtgcgcgtgcagcggcccgcgcgcaacgggaccgtcatggacgtgatctcccggcgcgaccagcggggcagcggccaggtgggcacgtacggcctgaacaccttcaccaacatggaggcccagctgatccgccagatggagtccgaggggatcttcagcccctccgagctcgagacccccaacctggccgagcgggtcctggactggctcgagaagcacggcgtggagcgcctgaagcggatggccatcagcggggacgactgcgtggtcaagccgatcgacgaccgcttcgccacggcgctgtccgccctcaacgacatgggcaaggtgcggaaggacatcccccagtgggagcccagcaaggggtggaacgactggcagcaggtccccttctgcagccaccacttccaccagctgatcatgaaggacggccgcgagatcgtcgtgccgtgccggaaccaggacgagctggtgggccgcgcccgggtctcccagggggccggctggagcctccgcgagaccgcctgcctggggaagtcctacgcgcagatgtggcagctgatgtacttccaccggcgcgacctccggctggccgccaacgccatctgcagcgcggtgcccgtggactgggtccccacctcccgcaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctcgggaagcgggaggaccagtggtgcggcagcctgatcggcctgacggcccgcgccacctgggccaccaacatccaggtggcgatcaaccaggtgcggcgcctcatcgggaacgagaactacctggactacatgacctccatgaagcggttcaagaacgacagcgaccccgagggcgccctgtggtga

SEQ ID NO: 8761 - RNA, 9879 nt, synthetic construct
  misc_feature 1..9879: note = derived and/or modified CDS sequence (opt1) from DENV-1__EU482487__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgccaagaacgagacctggaagctggcgcgggccagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgcgaacgccagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctccccgtgctgctgggcagcctcgggtgcaagccgctgaccatgttcctgatcgccgagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgggacgacaccctgaccatcctcctgaaggccacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgcggtgctcatgtaccaggggaagcgcctggagcccagctgggcctccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgcgaggggaagatcgtgggcctgtacggcaacggggtggtcaccaccagcggcacgtacgtgagcgccatcgcccaggccaaggcgtcccaggaggggccgctccccgagatcgaggacgaggtgttccggaagcgcaacctgaccatcatggacctgcaccccggcagcgggaagacccggcgctacctcccggccatcgtccgggaggccatcaagcgcaagctgcgcaccctgatcctcgcccccacgcgggtggtggcctccgagatggcggaggccctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgacggcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgcgaacttccgcgccgaccgggtcatcgacccgcgccggtgcctgaagcccgtgatcctgaaggacgggcccgagcgcgtgatcctcgccggccccatgccggtcaccgtggcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcggacgccccaggacaaccagctggcctacgtggtgatcgggctcctgttcatgatcctgaccgtcgccgcgaacgagatgggcctcctggagaccaccaagaaggacctggggatcggccacgccgccgtggagaaccaccaccacgccgccatgctcgacgtggacctgcaccccgcgtccgcctggacgctgtacgccgtcgccaccaccatcatcaccccgatgatgcgccacacgatcgagaacaccaccgccaacatcagcctcaccgcgatcgccaaccaggccgccatcctgatggggctggacaagggctggcccatctccaagatggacatcggcgtgcccctcctggcgctggggtgctacagccaggtgaaccccctcacgctgaccgccgccgtcctgatgctcgtggcccactacgccatcatcggcccggggctgcaggcgaaggccacccgcgaggcccagaagcggaccgccgccggcatcatgaagaaccccacggtggacgggatcgtcgcgatcgacctggaccccgtggtgtacgacgccaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtcagcatggcgaacatcttccgggggtcctacctggccggcgccggcctggccttcagcctcatgaagtccctcgggggcgggcgccgggggaccggggcgcagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgccgtgtcccgcggcaccgccaagctccggtggttcgtcgagcgcaacctggtgaagcccgaggggaaggtgatcgacctgggctgcggccgcgggggctggagctactactgcgccgggctgaagaaggtcacggaggtgaagggctacaccaagggcggccccggccacgaggagcccatcccgatggcgacctacgggtggaacctcgtgaagctgcactccggcaaggacgtcttcttcatcccgcccgagaagtgcgacaccctgctctgcgacatcggggagagctcccccaacccgacgatcgaggagggccgcaccctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgccgtgaacatgacgtcccgcatgctgctcaaccgcttcaccatggcccaccggaagcccacctacgagcgcgacgtcgacctgggggccggcacccggcacgtggccgtggagcccgaggtcgcgaacctggacatcatcggccagcgcatcgagaacatcaagcacgagcacaagagcacgtggcactacgacgaggacaacccctacaagacctgggcctaccacgggtcctacgaggtgaagccgagcggctccgccagcagcatggtgaacggggtcgtgaagctcctgaccaagccctgggacgtcatccccatggtgacccagatcgccatgacggacaccacccccttcggccagcagcgggtgttcaaggagaaggtcgacacccgcacgccgaaggccaagcgggggaccgcgcagatcatggaggtgaccgccaagtggctgtggggcttcctctcccgcaacaagaagccccggatctgcacccgcgaggagttcacgcggaaggtgcgcagcaacgccgccatcggcgcggtcttcgtggacgagaaccagtggaactccgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcgcgcatcaccgacatcatggagccggagcacgccctcctggccaagtccatcttcaagctgacctaccagaacaaggtcgtgcgcgtgcagcggcccgccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgcggagcgcgtcctggactggctgaagaagtacggcgtggagcggctcaagcgcatggccatctccggggacgactgcgtggtcaagccgatcgacgaccggttcgccacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtcgtgccgtgccgcaaccaggacgagctggtgggccgggcgcgcgtcagccagggggccggctggagcctgcgggagaccgcctgcctcgggaagtcctacgcccagatgtggcagctgatgtacttccaccgccgggacctgcgcctcgcggccaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctggggaagcgcgaggaccagtggtgcggcagcctcatcggcctgaccgcgcgggccacctgggccaccaacatccaggtcgccatcaaccaggtgcgccggctgatcgggaacgagaactacctcgactacatgacctccatgaagcgcttcaagaacgagggcgaccccgagggggccctgtggtga

SEQ ID NO: 8762 - RNA, 9879 nt, synthetic construct
  misc_feature 1..9879: note = derived and/or modified CDS sequence (opt1) from DENV-1__EU482488__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctcaccgactacggggccctgaccctggactgcagcccccggaccggcctcgacttcaacgagatggtcctgctgacgatgaaggagaagtcctggctcgtgcacaagcagtggttcctggacctgccgctcccctggaccagcggggcctccaccagccaggagacctggaaccggcaggacctgctggtgacgttcaagaccgcccacgcgaagaagcaggaggtcgtggtgctcggctcccaggagggcgccatgcacaccgccctgaccggggccacggagatccagaccagcggcaccaccacgatcttcgccgggcacctgaagtgccgcctcaagatggacaagctgaccctgaagggcatgtcctacgtcatgtgcaccgggagcttcaagctcgagaaggaggtggcggagacccagcacggcacggtgctggtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctgctgacctggctcggcctgaacagccgctccacgagcctgtccatgacctgcatcgccgtggggctcgtcaccctgtacctgggcgtgatggtgcaggccgacagcgggtgcgtcatcaactggaagggccgggagctcaagtgcgggagcggcatcttcgtgaccaacgaggtgcacacgtggaccgagcagtacaagttccaggcggactccccgaagcgcctgagcgccgccatcggcaaggcctgggaggagggggtctgcggcatccggtccgccacccgcctggagaacatcatgtggaagcagatcagcaacgagctcaaccacatcctgctggagaacgacatgaagctcaccgtggtggtcggggacgtggcgggcatcctggcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctctggtccaacggcgtgctggagagcgagatgatcatccccaagatctacgggggcccgatctcccagcacaactaccgccccgggtacttcacgcagaccgccggcccctggcacctggggaagctcgagctggacttcgacctgtgcgagggcaccaccgtggtcgtggacgagcactgcggcaaccgggggccgagcctccgcacgaccaccgtgaccggcaagatcatccacgagtggtgctgccggtcctgcacgctgccgcccctgcgcttcaagggggaggacggctgctggtacgggatggagatccggcccgtcaaggagaaggaggagaacctcgtcaagagcatggtgagcgccggctccggcgaggtcgacagcttctccctggggctgctctgcatcagcatcatgatcgaggaggtgatgcgctcccggtggagccgcaagatgctgatgaccggcaccctggccgtgttcttcctcctgatcatggggcagctgacctggaacgacctcatccggctgtgcatcatggtcggcgcgaacgcctccgaccgcatggggatgggcacgacctacctggccctcatggccaccttcaagatgcgcccgatgttcgccgtgggcctgctgttccggcgcctcaccagccgggaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatccgcacgaccttcagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgcgacgacaccctcaccatcctgctgaaggccaccctcctggccgtgagcggcgtgtacccgctgtccatccccgccaccctcttcgtctggtacttctggcagaagaagaagcagcggagcggggtgctgtgggacacgcccagcccgcccgaggtggagcgcgccgtcctggacgacggcatctaccggatcatgcagcgcggcctgctcgggcggagccaggtgggcgtgggggtcttccaggagaacgtgttccacaccatgtggcacgtgacccgcggcgcggtcctgatgtaccaggggaagcggctggagccctcctgggccagcgtgaagaaggacctcatctcctacggcggcgggtggcgcctgcagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagcccgggaccagcggcagccccatcgtgaaccgggaggggaagatcgtgggcctctacggcaacggggtcgtgacgacctccggcacctacgtgagcgccatcgcccaggccaaggcgtcccaggaggggcccctgccggagatcgaggacgaggtcttccgcaagcggaacctgaccatcatggacctccaccccggcagcgggaagacgcgccggtacctgcccgccatcgtgcgcgaggccatcaagcggcgcctgcgcaccctcatcctggccccgacccgggtggtcgcctccgagatggcggaggccctgaagggcatgcccatccgctaccagaccacggccgtcaagagcgagcacaccggcaaggagatcgtggacctcatgtgccacgccaccttcaccatgcggctgctgtcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctccggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctgaagccggtgatcctcaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctgaacaacgacgaggaccacgcccactggacggaggccaagatgctcctggacaacatcaacacccccgagggcatcatccccgccctgttcgagcccgagcgcgagaagtccgccgcgatcgacggggagtaccggctccgcggcgaggcccggaagaccttcgtggagctgatgcgccgcggggacctgccggtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacgtactccgaccccctggccctgcgggagttcaaggagttcgcggccggccgccggagcgtctccggggacctcatcctggagatcggcaagctgccccagcacctcacccagcgcgcccagaacgccctggacaacctggtgatgctccacaacagcgagcagggcgggcgggcgtaccgccacgccatggaggagctgccggacaccatcgagaccctgatgctcctggccctgatcgccgtgctcacgggcggggtcaccctgttcttcctgtccggccgggggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagcccgaccgccagcggaccccgcaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcacccccatgatgcgccacaccatcgagaacaccacggccaacatcagcctgaccgccatcgcgaaccaggccgccatcctgatggggctcgacaagggctggccgatctccaagatggacatcggcgtccccctgctggccctcgggtgctacagccaggtgaaccccctgaccctgaccgcggccgtgctcatgctggtcgcccactacgccatcatcggccccgggctgcaggccaaggcgacgcgcgaggcccagaagcggaccgccgccggcatcatgaagaacccgaccgtggacgggatcgtggccatcgacctcgaccccgtcgtgtacgacgcgaagttcgagaagcagctgggccagatcatgctgctcatcctgtgcacctcccagatcctgctcatgcgcacgacctgggccctgtgcgagagcatcaccctggccaccggccccctcacgaccctgtgggaggggtcccccggcaagttctggaacaccaccatcgccgtgagcatggccaacatcttccgggggagctacctggcgggcgccggcctcgccttctccctgatgaagtccctcgggggcgggcgccgggggacgggggcccagggcgagaccctcggcgagaagtggaagcgccagctgaaccagctgtccaagagcgagttcaacacctacaagcggtccgggatcatggaggtcgaccgcagcgaggcgaaggagggcctcaagcgcggggagaccacgaagcacgccgtgtcccgcggcaccgccaagctgcggtggttcgtggagcgcaacctggtcaagccggaggggaaggtgatcgacctgggctgcggccgcggcgggtggagctactactgcgccgggctcaagaaggtgaccgaggtcaaggggtacaccaagggcggccccggccacgaggagcccatccccatggccacgtacgggtggaacctggtgaagctgcactccggcaaggacgtgttcttcatcccgcccgagaagtgcgacaccctcctgtgcgacatcggggagagctcccccaaccccaccatcgaggagggccgcaccctgcgggtcctcaagatggtggagccgtggctgcgcgggaaccagttctgcatcaagatcctgaacccctacatgcccagcgtggtcgagacgctcgagcagatgcagcggaagcacggcggcatgctggtgcgcaaccccctgtcccggaacagcacccacgagatgtactgggtgtcctgcgggaccggcaacatcgtcagcgcggtgaacatgacctcccgcatgctcctgaaccgcttcaccatggcccaccggaagccgacgtacgagcgcgacgtggacctgggggccggcacccggcacgtcgccgtggagcccgaggtggccaacctcgacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctgctgacgaagccgtgggacgtgatccccatggtcacccagatcgccatgaccgacaccacgcccttcggccagcagcgggtgttcaaggagaaggtggacacccgcacccccaaggccaagcgggggaccgcccagatcatggaggtcacggcgaagtggctctggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggccaagatcaccgacatcatggagcccgagcacgcgctgctggccaagtccatcttcaagctcacgtaccagaacaaggtggtccgcgtgcagcgcccggccaagaacgggaccgtgatggacgtcatcagccggcgcgaccagcggggctccggccaggtgggcacctacggcctgaacaccttcacgaacatggaggcccagctgatccgccagatggagagcgaggggatcttctcccccagcgagctcgagacccccaacctggccggccgggtgctggactggctcgagaagcacggggtcgagcgcctgaagcggatggcgatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgcagccaccacttccaccagctgatcatgaaggacggccgcgagatcgtggtcccctgccggaaccaggacgagctggtggggcgcgcccgggtgtcccagggcgcggggtggagcctccgcgagacggcctgcctgggcaagtcctacgcccagatgtggcagctgatgtacttccaccggcgcgacctccggctggccgcgaacgccatctgcagcgccgtcccggtggactgggtgcccacctcccgcaccacctggagcatccacgcccaccaccagtggatgacgaccgaggacatgctgtccgtctggaaccgggtgtggatcgaggagaacccctggatggaggacaagacccacgtgagctcctgggaggacgtcccctacctcgggaagcgcgaggaccagtggtgcggcagcctgatcggcctgaccgcccgcgcgacgtgggccaccaacatccaggtggccatcaaccaggtgcggcgcctcctggggaacgagaactacctggactacatgacctccatgaagcggttcaagaacgagagcgacccggagggcgccctctggtga

SEQ ID NO: 8763 - RNA, 9879 nt, synthetic construct
  misc_feature 1..9879: note = derived and/or modified CDS sequence (opt1) from DENV-1__EU482489__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccctgatcgccctgttcctcgcccacgcgatcggcaccagcatcacccagaaggggatcatcttcatcctgctgatgctcgtgacgccctccatggccatgcggtgcgtgggcatcggcagccgcgacttcgtcgaggggctgtccggcgccacctgggtggacgtggtcctggagcacgggagctgcgtgaccaccatggccaaggacaagcccacgctcgacatcgagctgctgaagaccgaggtgaccaaccccgccgtcctccggaagctgtgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcggcctgttcggcaaggggtccctgatcacgtgcgccaagttcaagtgcgtgaccaagctggagggcaagatcgtgcagtacgagaacctcaagtacagcgtcatcgtgaccgtgcacacgggcgaccagcaccaggtcgggaacgagtccaccgagcacggcaccaccgccaccatcacgccccaggcgcccaccaccgagatccagctgaccgactacggggccctgacgctcgactgcagcccccgcaccggcctggacttcaacgagatggtgctgctcaccatgaaggagaagtcctggctggtccacaagcagtggttcctggacctccccctgccctggaccagcggggccagcacgtcccaggagacctggaaccggcaggacctgctcgtgaccttcaagaccgcccacgccaagaagcaggaggtggtcgtgctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtgatgtgcacggggtccttcaagctggagaaggagctggccgagacccagcacggcaccgtcctggtgcagatcaagtacgagggcaccgacgcgccctgcaagatccccttcagcacgcaggacgagaagggggtgacccagaacggccggctcatcaccgccaacccgatcgtcaccgacaaggagaagcccgtgaacatcgaggccgagccgcccttcggggagtcctacatcgtgatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtcttcaccagcgtggggaagctggtgcaccagatcttcggcaccgcctacggggtcctgttctccggcgtgagctggacgatgaagatcgggatcggcgtgctcctgacctggctgggcctcaactcccgcagcacctccctgagcatgacctgcatcgccgtcgggctggtgacgctctacctgggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtggtcgtgggggacgtggccggcatcctggcgcaggggaagaagatgatccggccccagcccatggagtacaagtacagctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtgtgcgaccaccgcctgatgtccgcggccatcaaggacagcaaggccgtccacgccgacatgggctactggatcgagtccgagaagaacgagacctggaagctcgcccgggcgagcttcatcgaggtgaagacgtgcatctggcccaagtcccacaccctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcacgaccgtcgtggtggacgagcactgcggcaaccgggggccgtccctgcgcaccaccacggtcaccggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcacgctcgccgtcttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtgggcctcctcttccgccggctgacctcccgcgaggtcctgctcctgaccatcgggctgagcctcgtggcctccgtggagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactacgcctggaagacgatggccatggtcctgagcatcgtgtccctgttccccctctgcctgagcaccacctcccagaagaccacgtggctgcccgtcctcctgggcagcctggggtgcaagccgctcaccatgttcctgatcgcggagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgacgctgctggccgtgtccggcgtctacccgctcagcatccccgccaccctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacgcggggcgccgtgctgatgtaccaggggaagcgcctcgagcccagctgggcgtccgtgaagaaggacctgatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtgcgggaggccatcaagcgcaagctccgcaccctgatcctggcccccacgcgggtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctcaagcccgtcatcctgaaggacgggcccgagcgcgtgatcctggccggccccatgccggtgaccgtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgcgaggcgcagaagcggaccgccgccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtcagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtgtcccgcggcaccgccaagctgcggtggttcgtcgagcgcaacctggtgaagcccgaggggaaggtgatcgacctcggctgcggccgcggcgggtggagctactactgcgccgggctgaagaaggtcacggaggtgaaggggtacaccaagggcgggcccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccgcaccctccgggtgctgaagatggtggagccctggctgcgcgggaaccagttctgcatcaagatcctcaacccctacatgcccagcgtcgtggagaccctggagcagatgcagcggaagcacggcggcatgctggtgcgcaacccgctctcccggaacagcacccacgagatgtactgggtctcctgcgggaccggcaacatcgtgagcgccgtgaacatgacgtcccgcatgctgctgaaccgcttcaccatggcgcaccggaagcccacctacgagcgcgacgtcgacctcggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctcaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctcatccggcagatggagagcgaggggatcttctcccccagcgagctggagacccccaacctggccgagcgcgtcctcgactggctggagaagtacggcgtggagcggctgaagcgcatggccatctccggggacgactgcgtggtcaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctggggaagcgcgaggaccagtggtgcggcagcctgatcggcctcaccgcccgggccacctgggcgaccaacatccaggtcgccatcaaccaggtgcgccggctgatcgggaacgagaactacctggactacatgacctccatgaagcgcttcaagaacgagagcgaccccgagggcgccctctggtga

SEQ ID NO: 8764 - RNA, 9879 nt, synthetic construct
  misc_feature 1..9879: note = derived and/or modified CDS sequence (opt1) from DENV-1__EU482490__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcacgatcggcgccggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctggtccaccagatcttcggcacggcctacggggtgctgttctccggcgtgagctggaccatgaagatcgggatcggcgtcctgctgacctggctcggcctgaactcccgcagcacctccctgagcatgacgtgcatcgccgtggggctcgtgaccctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacgcgcctggagaacatcatgtggaagcagatctccaacgagctcaaccacatcctgctggagaacgacatgaagttcaccgtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggacagctacacccaggtctgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggtggtcgacgagcactgcggcaaccgggggccgtccctgcgcaccacgaccgtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgacgggcaccctggccgtgttcttcctgctcatcatggggcagctgacctggaacgacctgatccgcctctgcatcatggtgggcgccaacgcgagcgaccgcatggggatgggcaccacgtacctggccctgatggccaccttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgacggacttccagtcccaccagctctgggccaccctgctgagcctcaccttcatcaagaccacgttctccctgcactacgcctggaagaccatggccatggtgctgagcatcgtctccctcttccccctgtgcctgagcaccacctcccagaagacgacctggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgacgatcctcctgaaggcgaccctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacacgatgtggcacgtgacccggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggacgttcaagacccccgagggcgaggtgggcgccatcgccctggacttcaagcccgggaccagcggctcccccatcgtcaaccgcgaggggaagatcgtgggcctgtacggcaacggggtggtcaccacgagcggcacctacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcacgctgatcctcgcccccacccgggtggtggcctccgagatggccgaggcgctgaagggcatgcccatccgctaccagaccaccgccgtcaagagcgagcacacgggcaaggagatcgtggacctgatgtgccacgccaccttcaccatgcggctcctgtcccccgtgcgcgtcccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcaccgacttccccggcaagacggtgtggttcgtgccctccatcaagagcggcaacgacatcgccaactgcctgcggaagaacgggaagcgcgtcatccagctctcccggaagaccttcgacaccgagtaccagaagaccaagaacaacgactgggactacgtggtgacgaccgacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacgcccgagggcatcatccccgccctgttcgagccggagcgcgagaagtccgccgccatcgacggggagtaccggctgcgcggcgaggcgcggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacgcagcgcgcccagaacgccctcgacaacctggtcatgctgcacaacagcgagcagggcgggcgggcctaccgccacgcgatggaggagctccccgacaccatcgagaccctgatgctgctcgccctgatcgccgtgctgaccggcggggtgaccctcttcttcctgtccggccgggggctgggcaagacgagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccacgaagaaggacctggggatcggccacgtggcggtggagaaccaccaccacgccgccatgctcgacgtcgacctgcaccccgcctccgcctggaccctgtacgcggtggccaccaccatcatcacgccgatgatgcgccacaccatcgagaacaccaccgccaacatcagcctcacggccatcgccaaccaggcggccatcctgatggggctggacaagggctggcccatctccaagatggacatcggcgtgcccctcctggccctggggtgctacagccaggtcaaccccctcaccctgaccgccgcggtgctgatgctcgtggcccactacgccatcatcggcccggggctgcaggccaaggccacccgcgaggcgcagaagcggacggccgccggcatcatgaagaaccccaccgtcgacgggatcgtggccatcgacctggaccccgtggtctacgacgccaagttcgagaagcagctcggccagatcatgctgctgatcctctgcacctcccagatcctgctgatgcgcaccacgtgggcgctctgcgagagcatcaccctggccaccggccccctgaccacgctctgggaggggtccccgggcaagttctggaacaccaccatcgccgtgagcatggccaacatcttccgggggtcctacctggccggcgcgggcctggccttcagcctcatgaagtccctcgggggcgggcgccgggggaccggggcccagggcgagacgctgggcgagaagtggaagcgccagctcaaccagctgtccaagagcgagttcaacacctacaagcggtccgggatcatggaggtggaccgcagcgaggccaaggagggcctgaagcgcggggagaccaccaagcacgcggtctcccgcggcacggccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggccacctacgggtggaacctcgtcaagctgcactccggcaaggacgtgttcttcatcccgcccgagaagtgcgacacgctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggacgggcaacatcgtgagcgccgtcaacatgacctcccgcatgctgctcaaccgcttcaccatggcgcaccggaagcccacctacgagcgcgacgtggacctgggggccggcacgcggcacgtggccgtcgagcccgaggtggccaacctggacatcatcggccagcgcatcgagaacatcaagcacgagcacaagagcacctggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacgcagatcgccatgaccgacaccacccccttcggccagcagcgggtcttcaaggagaaggtggacacgcgcaccccgaaggccaagcgggggaccgcccagatcatggaggtgaccgccaagtggctgtggggcttcctctcccgcaacaagaagccccggatctgcacgcgcgaggagttcacccggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacgcggatcaccgaggacgacctgcagaacgaggcccgcatcaccgacatcatggagccggagcacgccctcctggcgaagtccatcttcaagctgacctaccagaacaaggtggtgcgcgtccagcggcccgccaagaacgggacggtgatggacgtgatcagccgccgggaccagcgcggctccgggcaggtcggcacctacggcctcaacaccttcaccaacatggaggcccagctgatccggcagatggagagcgaggggatcttctcccccagcgagctggagacgcccaacctcgccgagcgcgtgctggactggctggagaagtacggcgtggagcggctcaagcgcatggccatctccggggacgactgcgtcgtgaagccgatcgacgaccggttcgcgaccgccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacgtccatgaagcgcttcaagaacgagagcgaccccgagggcgccctgtggtga

SEQ ID NO: 8765 - RNA, 9879 nt, synthetic construct
  misc_feature 1..9879: note = derived and/or modified CDS sequence (opt1) from DENV-1__EU482491__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagacctccgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcacccagatcggcgagcaccggcgcgacaagcggagcgtggccctggcgccccacgtgggcctcgggctggagacgcgcaccgagacctggatgtccagcgagggcgcctggaagcagatccagcgggtcgagacctgggccctgcgccaccccgggttcacggtgatcgccctcttcctggcgcacgccatcggcacctccatcacccagaaggggatcatcttcatcctgctcatgctggccacccccagcatggccatgcggtgcgtgggcatcggctcccgcgacttcgtcgaggggctgagcggcgccacgtgggtggacgtggtcctcgagcacgggtcctgcgtgaccaccatggcgaaggacaagcccaccctggacatcgagctgctcaagacggaggtgaccaaccccgccgtcctgcggaagctgtgcatcgaggccaagatcagcaacaccaccacggactcccgctgcccgacccagggcgaggccaccctcgtggaggagcaggacgccaacttcgtgtgccggcgcaccttcgtcgaccggggctgggggaacggctgcgggctgttcggcaaggggagcctgatcacgtgcgcgaagttcaagtgcgtgaccaagctcgagggcaagatcgtgcagtacgagaacctgaagtactccgtcatcgtgaccgtgcacaccggcgaccagcaccaggtcgggaacgagagcacggagcacggcaccatcgccaccatcacgccccaggccccctccaccgagatccagctgacggactacggggccctcaccctggactgcagcccccgcaccggcctggacttcaacgagatggtgctcctgaccatgaaggagaagtcctggctggtccacaagcagtggttcctcgacctgccgctgccctggacgagcggggccagcacctcccaggagacctggaaccggcaggacctcctggtgaccttcaagacggcgcacgccaagaagcaggaggtggtcgtgctgggcagccaggagggcgccatgcacaccgccctcaccggggccaccgagatccagacgtccggcaccaccaccatcttcgcggggcacctgaagtgccgcctgaagatggacaagctcacgctgcggggcatgagctacgtgatgtgcaccgggtccttcaagctggagaaggaggtcgccgagacccagcacggcaccgtgctcgtgcagatcaagtacgagggcacggacgccccctgcaagatccccttcagcacccaggacgagaagggggtcacccagaacggccgcctgatcaccgccaacccgatcgtgacggacaaggagaagcccgtgaacatcgaggcggagccgcccttcggggagtcctacatcgtcatcggcgccggcgagaaggccctgaagctgagctggttcaagaaggggtccagcatcggcaagatgttcgaggccaccgcccgcggggcccgccgcatggccatcctcggcgacaccgcctgggacttcgggtccatcggcggcgtgttcaccagcgtggggaagctggtccaccagatcttcggcacggcctacggggtgctgttctccggcgtgagctggaccatgaagatcgggatcggcgtcctcctgacctggctgggcctcaactcccggagcacctccctgagcatgacgtgcatcgccgtggggctggtgaccctctacctgggcgtcatggtgcaggcggactccgggtgcgtgatcaactggaagggccgcgagctgaagtgcgggagcggcatcttcgtcaccaacgaggtgcacacctggacggagcagtacaagttccaggccgacagcccgaagcggctctccgccgccatcggcaaggcctgggaggagggggtgtgcggcatccgcagcgcgacccggctggagaacatcatgtggaagcagatctccaacgagctgaaccacatcctcctggagaacgacatgaagctgaccgtcgtggtgggggacgtcgccggcatcctcgcccaggggaagaagatgatccgcccccagcccatggagtacaagtacagctggaagatctggggcaaggccaagatcatcggcgcggacgtgcagaacaccaccttcatcatcgacgggcccaacacgccggagtgccccgacgaccagcgggcctggaacatctgggaggtggaggactacggcttcgggatcttcaccaccaacatctggctgaagctgcgcgactcctacacccaggtctgcgaccaccggctcatgagcgccgccatcaaggactccaaggccgtgcacgcggacatgggctactggatcgagagcgagaagaacgagacgtggaagctggcccgcgcctccttcatcgaggtgaagacctgcatctggcccaagagccacaccctgtggtccaacggcgtcctcgagagcgagatgatcatccccaagatctacgggggcccgatctcccagcacaactaccggcccgggtacttcacccagacggccggcccctggcacctggggaagctggagctcgacttcgacctgtgcgagggcaccaccgtggtggtcgacgagcactgcggcaaccgcgggccgagcctgcggaccacgaccgtgaccggcaagatcatccacgagtggtgctgccgctcctgcaccctgccgcccctccggttcaagggggaggacggctgctggtacgggatggagatccgccccgtgaaggagaaggaggagaacctggtcaagagcatggtgtccgccggcagcggcgaggtggacagcttctccctcgggctgctgtgcatcagcatcatgatcgaggaggtcatgcggtcccgctggagccggaagatgctcatgacgggcaccctggcggtgttcttcctgctcatcatggggcagctgacctggaacgacctgatccgcctctgcatcatggtgggcgccaacgcctccgaccgcatggggatgggcaccacgtacctggccctgatggccaccttcaagatgcggccgatgttcgcggtcggcctcctgttccgccggctgaccagccgcgaggtgctcctgctgaccatcgggctctccctggtggccagcgtcgagctgcccaactccctcgaggagctgggcgacgggctggccatgggcatcatgatcctcaagctgctgacggacttccagagccaccagctctgggccaccctgctgtccctcaccttcatccggaccacgttcagcctgcactacgcgtggaagaccatggccatggtgctgtccatcgtcagcctcttccccctgtgcctgtccaccaccagccagaagacgacctggctccccgtgctgctgggctccctcgggtgcaagccgctgaccatgttcctgatcgccgagaacaagatctggggccgcaagagctggcccctcaacgaggggatcatggccgtgggcatcgtctccatcctgctgagcagcctcctgaagaacgacgtgcccctggccgggcccctcatcgcgggcggcatgctgatcgcctgctacgtgatctccgggagctccgccgacctgagcctcgagaaggccgccgaggtctcctgggaggaggaggcggagcacagcggcgcctcccacaacatcctggtggaggtgcaggacgacgggaccatgaagatcaaggacgaggagcgggacgacacgctgaccatcctcctgaaggccaccctgctcgccgtcagcggcgtgtacccgctgtccatccccgccaccctgttcgtgtggtacttctggcagaagaagaagcagcgcagcggggtcctctgggacacccccagcccgcccgaggtggagcgggcggtgctggacgacggcatctaccgcatcatgcagcggggcctgctggggcgcagccaggtcggcgtgggggtgttccaggagaacgtcttccacacgatgtggcacgtgacccggggcgccgtgctcatgtaccaggggaagcgcctggagccctcctgggccagcgtcaagaaggacctgatctcctacggcggcgggtggcggctccagggcagctggaacaccggggaggaggtccaggtgatcgccgtcgagcccggcaagaaccccaagaacgtgcagaccgcccccgggacgttcaagacctccgagggcgaggtgggcgcgatcgccctggacttcaagcccgggaccagcggctcccccatcgtcaaccgcgaggggaagatcgtgggcctgtacggcaacggggtggtcaccacgagcggcacctacgtgagcgccatcgcccaggcgaaggcctcccaggaggggcccctcccggagatcgaggacgaggtgttccggaagcgcaacctgaccatcatggacctgcaccccggcagcgggaagacccggcgctacctccccgccatcgtccgggaggccatcaagcgccgcctgcggacgctgatcctcgccccgacccgcgtggtggcgtccgagatggccgaggccctgaagggcatgcccatccggtaccagaccaccgccgtcaagagcgagcacacgggcaaggagatcgtggacctgatgtgccacgccaccttcaccatgcgcctcctgtcccccgtgcgggtccccaactacaacatgatcatcatggacgaggcgcacttcaccgacccgagctccatcgccgcccgcgggtacatcagcacgcgggtgggcatgggggaggccgccgcgatcttcatgaccgccacgccgcccggctccgtggaggccttcccccagagcaacgccgtcatccaggacgaggagcgcgacatcccggagcggtcctggaacagcgggtacgagtggatcaccgacttccccggcaagacggtgtggttcgtgccctccatcaagagcggcaacgacatcgcgaactgcctgcgcaagaacgggaagcgggtcatccagctctcccgcaagaccttcgacaccgagtaccagaagaccaagaacaacgactgggactacgtggtgacgaccgacatcagcgagatgggcgccaacttccgggccgaccgcgtcatcgacccccggcgctgcctgaagccggtgatcctgaaggacgggcccgagcgggtgatcctcgccggccccatgcccgtcaccgtggcctccgcggcccagcgccgggggcgcatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgggagaagtccgcggccatcgacggggagtaccgcctgcggggcgaggcccgcaagaccttcgtcgagctcatgcggcgcggggacctgccggtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgcgctgcgcgagttcaaggagttcgccgccggccggcgcagcgtgtccggggacctgatcctcgagatcggcaagctgccccagcacctgacgcagcgggcccagaacgcgctcgacaacctggtcatgctgcacaacagcgagcagggcgggcgcgcctaccggcacgccatggaggagctcccggacaccatcgagaccctgatgctgctcgccctgatcgccgtgctgaccggcggggtgaccctgttcttcctgtccggccgcgggctgggcaagaccagcatcggcctcctgtgcgtcatggcgtccagcgtgctgctctggatggcctccgtggagccccactggatcgccgccagcatcatcctggagttcttcctgatggtcctcctgatccccgagcccgaccggcagcgcaccccgcaggacaaccagctggcctacgtggtgatcgggctcctgttcatgatcctgaccgtcgcggccaacgagatgggcctcctggagaccacgaagaaggacctggggatcggccacgtggccgtggagaaccaccaccacgccgccatgctcgacgtcgacctgcaccccgcgtccgcctggaccctgtacgccgtggccaccaccatcatcacgcccatgatgcgccacaccatcgagaacaccaccgccaacatcagcctcacggcgatcgccaaccaggccgccatcctgatggggctggacaagggctggccgatctccaagatggacatcggcgtgcccctcctggcgctggggtgctacagccaggtcaaccccctcaccctgaccgccgccgtgctgatgctcgtggcccactacgccatcatcggccccgggctgcaggcgaaggccacccgggaggcccagaagcgcacggccgccggcatcatgaagaacccgaccgtcgacgggatcgtggcgatcgacctggaccccgtggtctacgacgccaagttcgagaagcagctcggccagatcatgctgctgatcctctgcacctcccagatcctgctgatgcggaccacgtgggccctctgcgagagcatcaccctggccaccggccccctgaccacgctctgggaggggtcccccggcaagttctggaacaccaccatcgccgtgagcatggcgaacatcttccgcgggtcctacctggccggcgccggcctggccttcagcctcatgaagtccctcgggggcgggcggcgcgggaccggggcgcagggcgagacgctgggcgagaagtggaagcggcagctcaaccagctgtccaagagcgagttcaacacctacaagcgctccgggatcatggaggtggaccggagcgaggccaaggagggcctgaagcgcggggagaccaccaagcacgccgtctcccggggcacggccaagctccgctggttcgtggagcggaacctggtgaagccggaggggaaggtcatcgacctgggctgcggccgcgggggctggagctactactgcgccgggctgaagaaggtgaccgaggtgaagggctacaccaagggcgggcccggccacgaggagcccatccccatggcgacctacgggtggaacctcgtcaagctgcactccggcaaggacgtgttcttcatcccgcccgagaagtgcgacacgctgctctgcgacatcggggagagctcccccaaccccaccatcgaggagggccggaccctgcgcgtgctgaagatggtcgagccgtggctccgggggaaccagttctgcatcaagatcctgaacccctacatgcccagcgtggtggagaccctggagcagatgcagcgcaagcacggcggcatgctcgtccggaaccccctgtcccgcaacagcacgcacgagatgtactgggtgtcctgcgggaccggcaacatcgtgagcgccgtcaacatgacctcccgcatgctgctcaaccggttcaccatggcccaccgcaagccgacctacgagcgggacgtggacctgggggccggcacgcgccacgtggccgtcgagcccgaggtggcgaacctggacatcatcggccagcggatcgagaacatcaagcacgagcacaagagcacctggcactacgacgaggacaacccctacaagacctgggcctaccacgggtcctacgaggtgaagcccagcggctccgccagcagcatggtcaacggggtggtcaagctcctgaccaagccgtgggacgtgatccccatggtgacgcagatcgccatgaccgacaccacccccttcggccagcagcgcgtcttcaaggagaaggtggacacgcggacccccaaggccaagcgcgggaccgcgcagatcatggaggtgaccgccaagtggctgtggggcttcctctcccggaacaagaagccgcgcatctgcacgcgggaggagttcacccgcaaggtccggagcaacgccgccatcggcgcggtgttcgtggacgagaaccagtggaactccgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacgcgcatcaccgaggacgacctgcagaacgaggcgaagatcaccgacatcatggagcccgagcacgccctcctggccaagtccatcttcaagctgacctaccagaacaaggtggtgcgcgtccagcggccggccaagaacgggacggtgatggacgtgatcagccgccgggaccagcgcggctccgggcaggtcggcacctacggcctcaacaccttcaccaacatggaggcccagctgatccggcagatggagagcgaggggatcttctcccccagcgagctggagacgcccaacctcgcgggccgcgtgctggactggctggagaagcacggggtggagcggctcaagcgcatggccatctccggcgacgactgcgtcgtgaagcccatcgacgaccggttcgccaccgccctgaccgccctgaacgacatggggaaggtgcgcaaggacatcccgcagtgggagcccagcaagggctggaacgactggcagcaggtccccttctgctcccaccacttccaccagctcatcatgaaggacggccgggagatcgtggtgccctgccgcaaccaggacgagctggtcgggcgggcgcgcgtgagccagggcgccgggtggagcctgcgggagaccgcctgcctcggcaagtcctacgcccagatgtggcagctgatgtacttccaccgccgggacctgcgcctcgcggccaacgccatctgcagcgccgtgccggtcgactgggtgcccacgtcccggaccacctggagcatccacgcccaccaccagtggatgaccacggaggacatgctgtccgtgtggaaccgcgtctggatcgaggagaacccctggatggaggacaagacccacgtgagctcctggggcgacgtgccctacctgggcaagcgcgaggaccagtggtgcggcagcctcatcgggctgaccgcgcgggccacctgggccacgaacatccaggtcgccatcaaccaggtgcgccggctgctcggcaacgagaactacctggactacatgacctccatgaagcgcttcaagaacgagagcgacccggagggggccctgtggtga

SEQ ID NO: 8766 - RNA, 9879 nt, synthetic construct
  misc_feature 1..9879: note = derived and/or modified CDS sequence (opt1) from DENV-1__EU482493__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcgtggggcagctgacctggaacgacctcatccgcctgtgcatcatggtcggcgccaacgcgagcgaccgcatggggatgggcaccacctacctggccctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtcctcagcgtggtgtccctgttccccctgtgcctcagcaccacctcccagaagaccacgtggctgcccgtcctgctcggcagcctggggtgcaagccgctgaccatgttcctcatcgcggagaacaagatctggggccggcgctcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgggacgacaccctcaccatcctgctgaaggcgacgctcctggccgtgtccggcgtctacccgctgagcatccccgccaccctcttcgtgtggtacttctggcagaagaagaagcagcgctccggggtgctgtgggacacccccagcccgcccgaggtcgagcgggccgtgctggacgacggcatctaccgcatcatgcagcggggcctgctcgggcgctcccaggtgggcgtcggggtgttccaggagaacgtgttccacaccatgtggcacgtcacgcggggcgccgtgctgatgtaccaggggaagcgcctggagcccagctgggcgtccgtgaagaaggacctcatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctctacggcaacggggtggtgaccaccagcggcacgtacgtcagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtgcgggaggccatcaagcgcaagctgcgcaccctcatcctggcccccacgcgggtcgtggcctccgagatggccgaggcgctgaagggcatgcccatccgctaccagaccaccgccgtcaagagcgagcacaccggcaaggagatcgtcgacctcatgtgccacgccacgttcaccatgcggctgctgtcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctgaagcccgtcatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgcctccgcctggacgctctacgcggtcgccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtcagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgccgtgaacatgacgtcccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtcctggactggctcgagaagtacggcgtggagcggctgaagcgcatggccatctccggggacgactgcgtggtcaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggccggctggagcctccgggagaccgcgtgcctggggaagtcctacgcccagatgtggcagctgatgtacttccaccgccgggacctccgcctggccgccaacgcgatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8767 - RNA, 9879 nt, synthetic construct
  misc_feature 1..9879: note = derived and/or modified CDS sequence (opt1) from DENV-1__EU482494__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatcacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggccacgccctccatggccatgcggtgcgtgggcatcggcagccgcgacttcgtcgaggggctctccggcgccacctgggtggacgtggtcctggagcacgggagctgcgtgaccaccatggccaaggacaagcccacgctggacatcgagctcctgaagaccgaggtgaccaaccccgcggtcctgcggaagctctgcatcgaggccaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgcgaccatcacgccccaggcccccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgcgaagaagcaggaggtggtcgtgctcggcagccaggagggcgccatgcacacggccctgaccggggccaccgagatccagacctccggcacgaccaccatcttcgccgggcacctgaagtgccgcctcaagatggacaagctgaccctgcggggcatgagctacgtgatgtgcacggggtccttcaagctcgagaaggaggtcgcggagacccagcacggcaccgtgctggtgcagatcaagtacgagggcaccgacgccccctgcaagatccccttcagcacgcaggacgagaagggggtcacccagaacggccgcctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccacggcccgcggggcccgccgcatggcgatcctgggcgacaccgcctgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccggagcacctccctgagcatgacctgcatcgccgtggggctcgtgacgctgtacctgggcgtcatggtgcaggccgactccgggtgcgtgatcaactggaagggccgcgagctcaagtgcgggagcggcatcttcgtcaccaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcacggtcgtggtgggggacgtcgcgggcatcctcgcccaggggaagaagatgatccgcccccagcccatggagcacaagtacagctggaagtcctggggcaaggccaagatcatcggcgccgacgtgcagaacaccaccttcatcatcgacgggcccaacaccccggagtgccccgacgaccagcgggcgtggaacatctgggaggtggaggactacggcttcgggatcttcacgaccaacatctggctgaagctgcgcgacagctacacccaggtctgcgaccaccggctcatgtccgccgccatcaaggacagcaaggccgtgcacgccgacatgggctactggatcgagtccgagaagaacgagacctggaagctggcgcgcgccagcttcatcgaggtgaagacgtgcatctggcccaagtcccacaccctgtggagcaacggcgtcctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtggtcgacgagcactgcggcaaccgcgggccgtccctgcggaccaccacggtgaccggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcacgctggccgtgttcttcctgctcatcatggggcagctgacctggaacgacctgatccgcctctgcatcatggtgggcgcgaacgccagcgaccggatggggatgggcaccacctacctggccctgatggccacgttcaagatgcgcccgatgttcgccgtcggcctcctgttccggcgcctgacctcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccacgctgctgagcctcaccttcatcaagaccaccttctccctgcactacgcctggaagacgatggcgatggtgctgagcatcgtctccctcttccccctgtgcctgagcaccacctcccagaagaccacgtggctccccgtgctgctgggcagcctcgggtgcaagccgctgaccatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccacgctgctcgccgtctccggcgtgtacccgctgagcatccccgccaccctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacgcgcggcgcggtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggaccagcggctcccccatcgtcaaccgggaggggaagatcgtgggcctgtacggcaacggggtggtcaccaccagcggcacgtacgtgagcgccatcgcccaggccaaggcgtcccaggaggggccgctccccgagatcgaggacgaggtgttccgcaagcggaacctgaccatcatggacctgcaccccggcagcgggaagacccgccggtacctcccggccatcgtccgcgaggccatcaagcgcaagctgcggaccctgatcctcgcccccacgcgcgtggtggcctccgagatggcggaggccctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgcgaacttccgggccgaccgcgtcatcgacccgcggcgctgcctgaagcccgtgatcctgaaggacgggcccgagcgggtgatcctcgccggccccatgccggtcaccgtggcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgccgcgaacgagatgggcctcctggagaccaccaagaaggacctggggatcggccacgtggccgtggagaaccaccaccacgccgccatgctcgacgtcgacctgcaccccgcctccgcgtggacgctgtacgccgtggccaccaccatcatcaccccgatgatgcgccacacgatcgagaacaccaccgccaacatcagcctcaccgccatcgcgaaccaggccgccatcctgatggggctggacaagggctggcccatctccaagatggacatcggcgtgcccctcctggccctggggtgctacagccaggtcaaccccctcacgctgaccgcggccgtgctgatgctcgtggcccactacgccatcatcggcccggggctgcaggccaaggcgacccgggaggcccagaagcgcaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacgtacaagcgctccgggatcatggaggtggaccggagcgaggcgaaggagggcctgaagcgcggggagaccaccaagcacgccgtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggaccggcaacatcgtgagcgcggtcaacatgacgtcccgcatgctgctcaaccggttcaccatggcccaccgcaagcccacctacgagcgggacgtggacctgggggccggcacccgccacgtggccgtcgagcccgaggtggccaacctggacatcatcggccagcggatcgagaacatcaagcacgagcacaagagcacgtggcactacgacgaggacaacccctacaagacctgggcgtaccacgggtcctacgaggtgaagccgagcggctccgccagcagcatggtcaacggggtggtcaagctcctgaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgcgaagtggctgtggggcttcctctcccggaacaagaagccccgcatctgcacccgggaggagttcacgcgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacaccgccggctgggacacccgcatcacggaggacgacctgcagaacgaggcccgcatcaccgacatcatggagccggagcacgcgctcctggccaagtccatcttcaagctgacctaccagaacaaggtggtgcgggtccagcgccccgccaagaacgggaccgtgatggacgtgatcagccggcgcgaccagcggggctccgggcaggtcggcacgtacggcctcaacaccttcaccaacatggaggcccagctgatccgccagatggagagcgaggggatcttctcccccagcgagctggagacccccaacctcgccgagcgggtgctggactggctggagaagtacggcgtggagcgcctcaagcggatggcgatctccggggacgactgcgtcgtgaagccgatcgacgaccgcttcgccacggccctgaccgccctgaacgacatgggcaaggtgcggaaggacatcccccagtgggagcccagcaaggggtggaacgactggcagcaggtccccttctgctcccaccacttccaccagctcatcatgaaggacggccgcgagatcgtggtgccgtgccggaaccaggacgagctggtcggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtgcccgtcgactggatccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgggaggaccagtggtgcggcagcctcatcggcctgaccgcccgcgcgacctgggccaccaacatccaggtggccatcaaccaggtgcggcgcctgatcgggaacgagaactacctcgactacatgacctccatgaagcggttcaagaacgagagcgaccccgagggcgccctgtggtga

SEQ ID NO: 8768 - RNA, 9879 nt, synthetic construct
  misc_feature 1..9879: note = derived and/or modified CDS sequence (opt1) from DENV-1__EU482495__SS-prME
  source 1..9879: mol_type = other RNA
tccgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgaggtggagcccgacgacgtggactgctggtgcaacaccaccgacacctgggtgacctacgggacctgcagccagacgggcgagcaccggcgcgacaagcggtccgtggccctcgcgccccacgtcggcctggggctggagacccgggccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgaagacggaggtgaccaaccccgccgtgctgcgcaagctctgcatcgaggcgaagatctccaacaccaccacggacagccggtgcccgacccagggcgaggccaccctggtcgaggagcaggacgccaacttcgtgtgccgccggaccttcgtggaccgcggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccgccaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccggctcaagatggacaagctgaccctgaagggcatgtcctacgtgatgtgcaccgggctgttcaagctggagaaggaggtggccgagacccagcacggcacggtcctggtgcagatcaagtacgagggcaccgacgcgccctgcaagatccccttcagcacccaggacgagaagggggtgacccagaacggccgcctgatcacggccaacccgatcgtcaccgacaaggagaagcccgtgaacatcgaggccgagccgcccttcggggagtcctacatcgtgatcggcgccggcgagaaggcgctcaagctgagctggttcaagaaggggtccagcatcggcaagatgttcgaggccaccgcccgcggggcccgccggatggccatcctgggcgacaccgcgtgggacttcgggtccatcggcggcgtcttcacgagcgtggggaagctcgtgcaccagatcttcggcaccgcctacggggtcctgttctccggcgtgagctggaccatgaagatcgggatcggcgtgctgctcacctggctgggcctgaactcccgcagcacgtccctcagcatgacctgcatcgccgtcgggctggtgaccctgtacctcggcgtgatggtccaggccgactccgggtgcgtgatcaactggaagggccgcgagctgaagtgcgggagcggcatcttcgtgaccaacgaggtccacacgtggaccgagcagtacaagttccaggccgacagcccgaagcggctgtccgcggccatcggcaaggcctgggaggagggggtgtgcggcatccgcagcgccacccggctcgagaacatcatgtggcgccagatctccaacgagctgaaccacatcctgctcgagaacgacatgaagttcaccgtggtcgtgggggacgtggtcggcatcctggcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctccgggacagctacacgcaggtctgcgaccaccgcctgatgtccgccgcgatcaaggacagcaaggccgtgcacgccgacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggcccgatcagccagcacaactaccgccccgggtacttcacgcagaccgcgggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtgaaggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcaccctggccgtgttcttcctcctgatcatggggcagctgacctggaacgacctcatccggagctgcatcatggtgggcgccaacgcctccgaccgcatggggatgggcacgacctacctggcgctgatggccaccttcaagatgcgcccgatgttcgccgtcggcctcctgttccggcgcctgaccagccgggaggtgctcctgctgacgatcgggctctccctggtcgccagcgtggagctgcccaactccctcgaggagctgggcgacgggctggccatgggcatcatgatcctcaagctgctgaccgacttccagagctaccagctctgggcgaccctgctgtccctcaccttcatcaagacgaccttcagcctgcactacgcctggaagaccatggccatggtgctgtccatcgtcagcctcctgcccctgtgcctctccaccacgagccagaagaccacctggctgcccgtgctgctcggctccctggggtgcaagccgctgaccatgttcctcatcgccgagaacaagatctggggccgcaagagctggcccctgaacgaggggatcatggcggtgggcatcgtcagcatcctgctctccagcctgctgaagaacgacgtgcccctcgccgggcccctgatcgccggcggcatgctgatcgcctgctacgtgatctccgggagctccgccgacctcagcctggagaaggcggccgaggtctcctgggaggaggaggccgagcacagcggcgcctcccacaacatcctggtggaggtgcaggacgacgggacgatgaagatcaaggacgaggagcgggacgacaccctcaccatcctgctgaaggccaccctcctggcggtcagcggcgtgtacccgctgtccatccccgccaccctcttcgtgtggtacttctggcagaagaagaagcagcgcagcggggtcctgtgggacacgcccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacccggggcgccgtgctgatgtaccaggggaagcgcctggagccctcctgggccagcgtcaagaaggacctcatctcctacggcggcgggtggcggctgcagggcagctggaacaccggggaggaggtccaggtgatcgcggtcgagcccggcaagaaccccaagaacgtgcagacggcccccgggaccttcaagacccccgagggcgaggtgggcgccatcgccctggacttcaagcccgggacctccggcagccccatcgtcaaccgcgaggggaagatcgtgggcctctacggcaacggggtggtcacgaccagcggcacctacgtgtccgccatcgcgcaggccaaggccagccaggaggggccgctgcccgagatcgaggacgaggtgttccggaagcgcaacctgaccatcatggacctccaccccggctccgggaagacgcggcgctacctgccggccatcgtccgggaggcgatcaagcgcaagctgcggaccctcatcctggcccccacccgcgtggtggccagcgagatggccgaggccctgaagggcatgcccatccgctaccagaccacggcggtcaagtccgagcacaccggccgggagatcgtggacctcatgtgccacgccaccttcaccatgcgcctgctgagccccgtgcgggtcccgaactacaacatgatcatcatggacgaggcccacttcacggacccctccagcatcgccgcccgcgggtacatctccacccgggtgggcatgggggaggcggccgccatcttcatgaccgccacgccgcccggcagcgtggaggccttcccgcagtccaacgcggtcatccaggacgaggagcgcgacatccccgagcggagctggaactccgggtacgagtggatcacggacttccccggcaagaccgtgtggttcgtgcccagcatcaagtccggcaacgacatcgccaactgcctccgcaagaacgggaagcgggtcatccagctgagccgcaagaccttcgacaccgagtaccagaagacgaagaacaacgactgggactacgtggtgaccaccgacatctccgagatgggcgccaacttccgggccgaccgcgtcatcgacccgcggcgctgcctgaagcccgtgatcctcaaggacgggcccgagcgggtcatcctggcgggccccatgccggtgaccgtggccagcgccgcccagcgccgggggcgcatcggccggaaccacaacaaggagggcgaccagtacatctacatggggcagcccctgaacaacgacgaggaccacgcccactggacggaggcgaagatgctcctggacaacatcaacacccccgagggcatcatccccgccctgttcgagccggagcgcgagaagtccgccgccatcgacggggagtaccgcctccggggcgaggcccgcaagaccttcgtcgagctgatgcggcgcggggacctgcccgtgtggctcagctacaaggtggcgagcgagggcttccagtactccgaccggcgctggtgcttcgacggcgagcggaacaaccaggtcctggaggagaacatggacgtggagatctggaccaaggagggggagcgcaagaagctgcggccccgctggctcgacgcccggacgtacagcgaccccctggccctgcgcgagttcaaggagttcgccgccggccggcgctccgtgagcggggacctcatcctggagatcggcaagctgccgcagcacctcacccagcgggcgcagaacgccctggacaacctggtcatgctccacaactccgagcagggcgggcgcgcctaccggcacgccatggaggagctgcccgacaccatcgagaccctgatgctcctggcgctgatcgccgtgctcacgggcggggtgaccctgttcttcctgagcggccgcgggctcggcaagacctccatcggcctgctgtgcgtcatggccagctccgccctcctgtggatggccagcgtggagccccactggatcgcggcctccatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagacgaccaagaaggacctcgggatcggccacgtcgcggtggagaaccaccaccacgccaccatgctggacatcgacctgcaccccgccagcgcctggaccctctacgccgtggcgacgaccatcatcaccccgatgatgcggcacaccatcgagaacacgaccgccaacatctccctgaccgccatcgccaaccaggccgcgatcctgatggggctcgacaagggctggcccatcagcaagatggacatcggcgtccccctgctggccctcgggtgctactcccaggtgaaccccctgaccctgacggccgccgtgctcatgctggtcgcgcactacgccatcatcggcccggggctgcaggccaaggccacccgcgaggcccagaagcgcaccgcggccggcatcatgaagaaccccaccgtggacgggatcgtggccatcgacctcgaccccgtcgtgtacgacgccaagttcgagaagcagctgggccagatcatgctgctcatcctgtgcacgagccagatcctgctcatgcggaccacctgggccctgtgcgagtccatcaccctggcgacgggccccctcaccaccctgtgggaggggagcccgggcaagttctggaacaccacgatcgccgtgtccatggccaacatcttccgcgggagctacctggccggcgccggcctcgcgttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtcgaccggtccgaggccaaggagggcctccgccgcggggagacgaccaagcacgccgtgagccgcggcaccgcgaagctgcggtggttcgtggagcgcaacctggtcaagcccgaggggaaggtgatcgacctgggctgcggccgcggcgggtggtcctactactgcgccgggctcaagaaggtgaccgaggtcaaggggtacacgaagggcggccccggccacgaggagcccatcccgatggccacctacgggtggaacctggtgaagctgcacagcggcaaggacgtgttcttcatcccgcccgagaagtgcgacaccctcctgtgcgacatcggggagtccagccccaacccgaccatcgaggagggccgcacgctgcgggtcctcaagatggtggagccctggctgcgcgggaaccagttctgcatcaagatcctgaacccctacatgccctccgtggtcgagaccctcgagcagatgcagcggaagcacggcggcatgctggtgcgcaacccgctgagccggaactccacccacgagatgtactgggtgagctgcgggaccggcaacatcgtctccgccgtgaacatgaccagccgcatgctcctgaaccgcttcacgatggcccaccggaagcccacctacgagcgcgacgtggacctgggggcgggcacccggcacgtcgccgtggagcccgaggtggccaacctcgacatcatcggccagcgcatcgagaacatcaagcacgagcacaagtccacctggcactacgacgaggacaacccctacaagacgtgggcctaccacgggagctacgaggtcaagccgtccggcagcgccagctccatggtgaacggggtcgtgaagctgctgaccaagccctgggacgtgatccccatggtcacccagatcgcgatgaccgacacgacccccttcggccagcagcgggtgttcaaggagaaggtggacacccgcaccccgaaggccaagcgggggacggcccagatcatggaggtcaccgcccgctggctctggggcttcctgagccggaacaagaagccccgcatctgcacccgggaggagttcacccgcaaggtgcggtccaacgccgcgatcggcgccgtgttcgtcgacgagaaccagtggaacagcgccaaggaggccgtggaggacgagcgcttctgggacctggtgcaccgggagcgcgagctccacaagcaggggaagtgcgcgacgtgcgtctacaacatgatgggcaagcgggagaagaagctgggggagttcggcaaggccaaggggtcccgcgccatctggtacatgtggctgggcgcccggttcctcgagttcgaggccctgggcttcatgaacgaggaccactggttcagccgcgagaactccctgagcggggtggagggcgaggggctccacaagctgggctacatcctgcgggacatctccaagatccccgggggcaacatgtacgcggacgacaccgccggctgggacacccgcatcaccgaggacgacctccagaacgaggccaagatcacggacatcatggagccggagcacgccctgctggccaccagcatcttcaagctcacctaccagaacaaggtggtccgcgtgcagcggcccgcgcgcaacgggaccgtgatggacgtcatctcccggcgcgaccagcggggcagcggccaggtgggcacgtacggcctgaacaccttcaccaacatggaggcccagctgatccgccagatggagtccgaggggatcttcagcccctccgagctcgagacccccaacctggccgagcgggtgctggactggctcgagaagcacggcgtcgagcgcctgaagcggatggccatcagcggggacgactgcgtggtgaagccgatcgacgaccgcttcgccacggcgctgtccgccctcaacgacatgggcaaggtccggaaggacatcccccagtgggagcccagcaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgcggtccccgtggactgggtgcccacctcccgcaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctcgggaagcgggaggaccagtggtgcggcagcctgatcggcctgacggcccgcgccacctgggccaccaacatccaggtcgcgatcaaccaggtgcggcgcctcatcgggaacgagaactacctggactacatgacctccatgaagcggttcaagaacgacagcgaccccgagggcgccctgtggtga

SEQ ID NO: 8769 - RNA, 9879 nt, synthetic construct
  misc_feature 1..9879: note = derived and/or modified CDS sequence (opt1) from DENV-1__EU482496__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctgaagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagagcgaccccgagggcgccctgtggtga

SEQ ID NO: 8770 - RNA, 9879 nt, synthetic construct
  misc_feature 1..9879: note = derived and/or modified CDS sequence (opt1) from DENV-1__EU482497__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccagggcacctggaaccggcaggacctgctggtgaccttcaagaccgcccacgccaagaagcaggaggtcgtggtgctcggcagccaggagggggcgatgcacacggccctgaccggcgccaccgagatccagacctccgggacgaccaccatcttcgccggccacctgaagtgccgcctcaagatggacaagctgaccctgaaggggatgagctacgtcatgtgcacgggctccttcaagctcgagaaggaggtggccgagacccagcacggcaccgtgctggtccagatcaagtacgaggggaccgacgcgccctgcaagatccccttcagcacgcaggacgagaagggcgtgacccagaacgggcggctgatcaccgccaacccgatcgtgaccgacaaggagaagcccgtcaacatcgaggccgagccgcccttcggcgagtcctacatcgtgatcggcgccggggagaaggcgctgaagctcagctggttcaagaagggctccagcatcgggaagatgttcgaggccacggcccgcggcgcccggcgcatggccatcctgggggacaccgcgtgggacttcggctccatcggcggggtgttcaccagcgtcggcaagctggtgcaccagatcttcgggaccgcctacggcgtcctcttctccggggtcagctggacgatgaagatcggcatcggcgtgctgctgacctggctcgggctgaactcccgcagcacctccctgagcatgacctgcatcgccgtgggcctcgtcacgctgtacctgggggtgatggtgcaggccgactccggctgcgtcatcaactggaaggggcgggagctcaagtgcggcagcggcatcttcgtgaccaacgaggtgcacacctggaccgagcagtacaagttccaggccgacagcccgaagcgcctgtccgcggccatcgggaaggcctgggaggagggcgtctgcgggatccggagcgccacccgcctggagaacatcatgtggaagcagatctccaacgagctcaaccacatcctgctggagaacgacatgaagttcacggtggtggtcggcgacgtggccgggatcctcgcgcagggcaagaagatgatccggccccagcccatggagtacaagtacagctggaagtcctggggcaaggccaagatcatcggggccgacgtgcagaacaccaccttcatcatcgacggccccaacaccccggagtgccccgacgaccagcgcgcctggaacatctgggaggtcgaggactacgggttcggcatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtcgtggacgagcactgcgggaaccggggcccgtccctgcgcaccaccacggtgaccgggaagatcatccacgagtggtgctgccggagctgcaccctgccgcccctccgcttccggggcgaggacgggtgctggtacggcatggagatccgccccgtcaaggagaaggaggagaacctggtgaagtccatggtgagcgccggcagcggggaggtcgactccttcagcctcggcctgctgtgcatctccatcatgatcgaggaggtgatgcggagccgctggtcccggaagatgctcatgaccgggacgctggccgtgttcttcctgctcatcatgggccagctgacctggaacgacctgatccgcctctgcatcatggtcggggccaacgcgagcgaccgcatgggcatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggggacggcctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctggggagcctcggctgcaagccgctgaccatgttcctgatcgcggagaacaagatctgggggcggcgctcctggcccctcaacgagggcatcatggccgtcgggatcgtgagcatcctgctgagctccctcctgaagaacgacgtgcccctggccggccccctcatcgccggcgggatgctgatcgcctgctacgtcatcagcggctccagcgcggacctgtccctcgagaaggccgccgaggtgagctgggaggaggaggccgagcactccggggccagccacaacatcctggtggaggtccaggacgacggcaccatgaagatcaaggacgaggagcgggacgacaccctgaccatcctcctgaaggcgacgctgctcgccgtgtccggggtgtacccgctgagcatccccgccaccctgttcgtctggtacttctggcagaagaagaagcagcgctccggcgtgctctgggacacccccagcccgcccgaggtggagcgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccggatcacggaggacgacctgcagaacgaggcccgcatcaccgacaccatggagccggagcacgccctcctggcgcgctccatcttcaagctgacctaccagaacaaggtggtccgggtgcagcgccccgccaagaacggcacggtgatggacgtcatcagccggcgcgaccagcgggggtccggccaggtgggcacctacgggctcaacaccttcaccaacatggaggcccagctgatccgccagatggagagcgagggcatcttctcccccagcgagctggagacgcccaacctcgccgagcgggtgctggactggctggagaagtacggggtcgagcgcctcaagcggatggccatctccggcgacgactgcgtggtgaagccgatcgacgaccgcttcgcgaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcgtgcctcggcaagtcctacgcccagatgtggcagctgatgtacttccaccggcgcgacctgcggctcgccgccaacgcgatctgcagcgccgtccccgtggactggatccccacgtcccgcaccacctggagcatccacgcccaccaccagtggatgaccacggaggacatgctgtccgtgtggaaccgcgtctggatcgaggagaacccctggatggaggacaagacccacatcagctcctggggcgacgtgccgtacctgggcaagcgggaggaccagtggtgcggcagcctcatcgggctgaccgcccgcgccacctgggcgaccaacatccaggtggccatcaaccaggtccggcgcctgatcggcaacgagaactacctcgactacatgacgtccatgaagcggttcaagaacgagagcgaccccgagggggccctgtggtga

SEQ ID NO: 8771 - RNA, 9879 nt, synthetic construct
  misc_feature 1..9879: note = derived and/or modified CDS sequence (opt1) from DENV-1__EU482499__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctcctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctctcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagccggagcacgccctcctggcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctgaagaagtacggcgtggagcggctcaagcgcatggccatctccggggacgactgcgtcgtgaagccgatcgacgaccggttcgcgacggccctgaccgccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcggccgggcccgcgtgagccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctgggaggacgtcccgtacctgggcaagcgcgaggaccagtggtgcgggagcctcatcggcctgaccgcccgggccacctgggcgaccaacatccaggtggccatcaaccaggtgcgccggctgatcggcaacgagaactacctcgactacatgacctccatgaagcgcttcaagaacgagggggaccccgagggcgccctgtggtga

SEQ ID NO: 8772 - RNA, 9879 nt, synthetic construct
  misc_feature 1..9879: note = derived and/or modified CDS sequence (opt1) from DENV-1__EU482500__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcatcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagccacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggccaaggcctcccaggaggggccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccggcaaggagatcgtggacctgatgtgccacgccacgttcaccatgcggctcctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctgaaggacgggcccgagcgcgtgatcctcgccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgcgagaagtccgccgccatcgacggggagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggaccaaggagggggagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccggcggggtgaccctcttcttcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggcgtgcccctcctggccctggggtgctacagccaggtcaaccccctcacgctgaccgccgcggtgctgatgctcgtggcccactacgccatcatcggcccggggctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtccccgggcaagttctggaacacgaccatcgccgtgagcatggccaacatcttccgggggtcctacctggccggcgcgggcctggccttcagcctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctccggtggttcgtggagcgcaacctggtgaagcccgaggggaaggtcatcgacctgggctgcggccgcgggggctggagctactactgcgccgggctgaagaaggtgacggaggtgaagggctacaccaagggcggccccggccacgaggagcccatcccgatggccacctacgggtggaacctcgtcaagctgcactccggcaaggacgtgttcttcatcccgcccgagaagtgcgacaccctgctctgcgacatcggggagagctcccccaacccgacgatcgaggagggccgcaccctgcgggtgctgaagatggtcgagccctggctccgcgggaaccagttctgcatcaagatcctgaacccctacatgcccagcgtggtggagaccctggagcagatgcagcggaagcacggcggcatgctcgtccgcaacccgctgtcccggaacagcacccacgagatgtactgggtgtcctgcgggaccggcaacatcgtgagcgccgtcaacatgacgtcccgcatgctgctcaaccgcttcaccatggcgcaccggaagcccacctacgagcgcgacgtggacctgggggccggcacccggcacgtggccgtcgagcccgagatcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctcctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctctcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctggtccaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggaggccgagcacgcgctcctggccaagtccatcttcaagctgacctaccagaacaaggtcgtgcgcgtgcagcggccggccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtcctggactggctggagaagtacggcgtggagcggctcaagcgcatggcgatctccggggacgactgcgtggtcaagcccatcgacgaccggttcgccacggccctgaccgccctgaacgacatgggcaaggtgcgcaaggacatcccgcagtgggagcccagcaaggggtggaacgactggcagcaggtccccttctgctcccaccacttccaccagctcatcatgaaggacggccgggagatcgtcgtgccctgccgcaaccaggacgagctggtgggccgggcccgcgtcagccagggggcgggctggagcctgcgggagaccgcctgcctcgggaagtcctacgcccagatgtggcagctgatgtacttccaccgccgggacctgcgcctcgccgcgaacgccatctgcagcgccgtgccggtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccctacctggggaagcgcgaggaccagtggtgcggcagcctcatcggcctgaccgcccgggcgacctgggccaccaacatccaggtcgccatcaaccaggtgcgccggctgatcgggaacgagaactacctcgactacatgacctccatgaagcgcttcaagaacgagggcgacccggagggggccctgtggtga

SEQ ID NO: 8773 - RNA, 9879 nt, synthetic construct
  misc_feature 1..9879: note = derived and/or modified CDS sequence (opt1) from DENV-1__EU482501__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctcaacaccttcaccaacatggaggcccagctgatccggcagatggagagcgagggcatcttctcccccagcgagctggagacccccaacctcgccgagcgcgtgctggactggctggagaagtacggggtcgagcggctcaagcgcatggccatctccggcgacgactgcgtggtgaagccgatcgacgaccggttcgcgacggccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcgtgcctcggcaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgcgaggaccagtggtgcggcagcctcatcgggctgaccgcccgggccacctgggcgaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8774 - RNA, 9879 nt, synthetic construct
  misc_feature 1..9879: note = derived and/or modified CDS sequence (opt1) from DENV-1__EU482504__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtgggcctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggtcacgctgctgagcctcaccttcatcaagaccaccttctccctgcactacgcctggaagacgatggccatggtgctgagcatcgtgtccctcttccccctgtgcctgagcaccacctcccagaagaccacgtggctccccgtcctgctgggcagcctcgggtgcaagccgctgaccatgttcctgatcgccgagaacaagatctggggccggcgctcctggcccctcaacgaggggatcatggcggtgggcatcgtgagcatcctgctgagctccctcctgaagaacgacgtccccctggccgggcccctcatcgccggcggcatgctgatcgcctgctacgtgatcagcgggtccagcgccgacctgtccctcgagaaggcggccgaggtgagctgggaggaggaggccgagcactccggcgccagccacaacatcctggtcgaggtgcaggacgacgggaccatgaagatcaaggacgaggagcgggacgacaccctgaccatcctcctgaaggccacgctgctcgcggtgtccggcgtctacccgctgagcatccccgccaccctgttcgtgtggtacttctggcagaagaagaagcagcgctccggggtgctctgggacacccccagcccgcccgaggtcgagcgggccgtgctggacgacggcatctaccgcatcatgcagcggggcctgctggggcgctcccaggtgggcgtcggggtgttccaggagaacgtgttccacaccatgtggcacgtcacgcggggcgccgtgctcatgtaccaggggaagcgcctggagcccagctgggcctccgtgaagaaggacctgatcagctacggcggcgggtggcggctccagggctcctggaacaccggggaggaggtccaggtgatcgcggtggagcccggcaagaaccccaagaacgtccagaccgcccccgggaccttcaagacgcccgagggcgaggtgggcgccatcgccctggacttcaagcccgggaccagcggctcccccatcgtgaaccgcgaggggaagatcgtcggcctgtacggcaacggggtggtgaccaccagcggcacgtacgtcagcgccatcgcgcaggccaaggcctcccaggaggggccgctccccgagatcgaggacgaggtgttccggaagcgcaacctgaccatcatggacctgcaccccggcagcgggaagacccggcgctacctcccggccatcgtgcgggaggcgatcaagcgcaagctgcgcaccctgatcctcgcccccacgcgggtcgtggcctccgagatggccgaggccctgaagggcatgcccatccgctaccagaccaccgcggtcaagagcgagcacaccggcaaggagatcgtcgacctgatgtgccacgccacgttcaccatgcggctcctgtcccccgtgcgcgtgccgaactacaacatgatcatcatggacgaggcccacttcaccgaccccagctccatcgccgcccgggggtacatcagcacccgcgtcggcatgggggaggcggccgccatcttcatgacggccacgccgcccggctccgtggaggccttcccgcagagcaacgcggtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctctcccggaagacgttcgacaccgagtaccagaagaccaagaacaacgactgggactacgtcgtgaccacggacatcagcgagatgggcgccaacttccgcgccgaccgggtgatcgacccgcgccggtgcctgaagcccgtcatcctgaaggacgggcccgagcgcgtgatcctcgcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctgctcgacaacatcaacacccccgagggcatcatccccgccctgttcgagccggagcgcgagaagtccgccgccatcgacggggagtaccggctgcgcggcgaggcccggaagacgttcgtggagctcatgcgccgcggggacctgcccgtctggctgtcctacaaggtggcgagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgccgccggccgccggagcgtgtccggggacctgatcagcgagatcggcaagctcccgcagcacctgacccagcgcgcgcagaacgccctggacaacctcgtgatgctgcacaactccgagcagggcgggcgggcctaccgccacgccatggaggagctgcccgacacgatcgagaccctcatgctgctggcgctcatcgccgtcctgaccggcggggtgaccctgttcttcctcagcggccgggggctgggcaagacctccatcggcctgctctgcgtgatggccagctccgtcctgctgtggatggccagcgtggagccccactggatcgccgcgtccatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgccgtggagaaccaccaccacgcggccatgctggacgtggacctccaccccgccagcgcctggacgctgtacgccgtcgcgaccaccatcatcaccccgatgatgcgccacacgatcgagaacaccaccgccaacatctccctgaccgccatcgccaaccaggccgcgatcctcatggggctggacaagggctggcccatcagcaagatggacatcggcgtgcccctgctcgccctggggtgctactcccaggtgaaccccctgacgctcaccgccgccgtcctgatgctggtggcgcactacgccatcatcggcccggggctccaggccaaggccacccgcgaggcccagaagcggaccgcggccggcatcatgaagaaccccacggtggacgggatcgtcgccatcgacctggaccccgtggtgtacgacgccaagttcgagaagcagctgggccagatcatgctcctgatcctgtgcaccagccagatcctcctgatgcgcaccacctgggccctgtgcgagtccatcacgctcgcgaccggccccctgaccaccctgtgggaggggagcccgggcaagttctggaacacgaccatcgccgtctccatggccaacatcttccgggggagctacctcgccggcgccggcctggcgttcagcctgatgaagtccctcgggggcgggcgccggggcaccggggcccagggcgagaccctgggcgagaagtggaagcgccagctgaaccagctcagcaagtccgagttcaacacgtacaagcggagcgggatcatggaggtggaccgctccgaggccaaggagggcctgaagcgcggggagaccaccaagcacgccgtgagccgcggcaccgcgaagctgcggtggttcgtcgagcgcaacctcgtgaagcccgaggggaaggtgatcgacctgggctgcggccgcggcgggtggtcctactactgcgccgggctgaagaaggtcacggaggtgaaggggtacaccaagggcgggcccggccacgaggagcccatcccgatggccacctacgggtggaacctggtgaagctccacagcggcaaggacgtcttcttcatcccgcccgagaagtgcgacaccctgctgtgcgacatcggggagtccagccccaacccgacgatcgaggagggccgcaccctccgggtgctgaagatggtggagccctggctgcgcgggaaccagttctgcatcaagatcctcaacccctacatgccctccgtcgtggagaccctggagcagatgcagcggaagcacggcggcatgctggtgcgcaacccgctcagccggaactccacccacgagatgtactgggtcagctgcgggaccggcaacatcgtgtccgccgtgaacatgacgagccgcatgctgctgaaccgcttcaccatggcccaccggaagcccacctacgagcgcgacgtcgacctcggggcgggcacccggcacgtggccgtggagcccgaggtcgccaacctggacatcatcggccagcgcatcgagaacatcaagcacgagcacaagtccacgtggcactacgacgaggacaacccctacaagacctgggcctaccacgggagctacgaggtgaagccgtccggcagcgccagctccatggtcaacggggtggtgaagctgctcaccaagccctgggacgtcatccccatggtgacccagatcgcgatgacggacaccacccccttcggccagcagcgggtgttcaaggagaaggtcgacacccgcacgccgaaggccaagcgggggaccgcccagatcatggaggtgaccgccaagtggctgtggggcttcctgagccgcaacaagaagccccggatctgcacccgcgaggagttcacgcggaaggtgcgctccaacgccgcgatcggcgccgtcttcgtggacgagaaccagtggaacagcgccaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgcggacgacaccgccggctgggacacccggatcacggaggacgacctgcagaacgaggcccgcatcaccgacatcatggagccggagcacgccctgctcgccaagagcatcttcaagctgacctaccagaacaaggtcgtgcgcgtgcagcggcccgcgaagaacgggaccgtcatggacgtgatctcccgccgggaccagcgcggcagcggccaggtggggacgtacggcctgaacaccttcaccaacatggaggcccagctcatccggcagatggagtccgaggggatcttcagcccctccgagctggagacccccaacctggccgagcgcgtcctcgactggctggagaagtacggcatcgagcggctgaagcgcatggccatcagcggggacgactgcgtggtgaagccgatcgacgaccggttcgccacggcgctcaccgccctgaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctcgtgggccgggcccgcgtgagccagggggccggctggtccctgcgggagaccgcctgcctgggcaagagctacgcgcagatgtggcagctcatgtacttccaccgccgggacctgcgcctggccgccaacgccatctgctccgcggtccccgtggactggatccccaccagccggacgacctggtccatccacgcccaccaccagtggatgaccaccgaggacatgctcagcgtgtggaaccgcgtctggatcgaggagaacccctggatggaggacaagacgcacatctccagctggggcgacgtgccgtacctggggaagcgcgaggaccagtggtgcggctccctgatcggcctcaccgcccgggccacctgggccaccaacatccaggtggcgatcaaccaggtccgccggctgatcgggaacgagaactacctggactacatgaccagcatgaagcgcttcaagaacgagtccgaccccgagggcgccctctggtga

SEQ ID NO: 8775 - RNA, 9879 nt, synthetic construct
  misc_feature 1..9879: note = derived and/or modified CDS sequence (opt1) from DENV-1__EU482505__SS-prME
  source 1..9879: mol_type = other RNA
agcgtgaccatgctgctcatgctgatgcccaccgcgctggccttccacctcaccacccggggcggggagccccacatgatcgtgtccaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaaggcctggctggtgcacaagcagtggttcctcgacctgccgctgccctggaccagcggggccagcacctcccaggagacgtggaaccggaaggacctcctggtgaccttcaagaccgcgcacgccaagaagcaggaggtcgtggtgctgggcagccaggagggcgccatgcacaccgccctcacgggggccaccgagatccagacctccggcaccacgaccatcttcgcggggcacctgaagtgccgcctgaagatggacaagctcaccctgaagggcatgagctacgtcatgtgcaccgggtccttcaagctggagaaggaggtggccgagacgcagcacggcaccgtgctcgtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggcggagccgcccttcggggagtcctacatcgtgatcggcgccggcgagaaggccctgaagctgagctggttcaagaaggggtccagcatcggcaagatgttcgaggccaccgcccgcggggcgcggcgcatggccatcctcggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctcctgacgtggctgggcctcaactcccgcagcacctccctgagcatgacctgcatcgccgtggggctggtcaccctctacctgggcgtgatggtgcaggcggactccgggtgcgtcatcaactggaagggccgggagctgaagtgcgggagcggcatcttcgtgacgaacgaggtgcacacctggaccgagcagtacaagttccaggccgacagcccgaagcgcctctccgccgccatcggcaaggcctgggaggagggggtctgcggcatccggagcgcgacccgcctggagaacatcatgtggaagcagatctccaacgagctgaaccacatcctcctggagaacgacatgaagttcaccgtggtggtcggggacgtggccggcatcctggcccaggggaagaagatgatccggccccagcccatggagcacaagtacagctggaagtcctggggcaaggccaagatcatcggcgcggacgtgcagaacgccacgttcatcatcgacgggcccaacaccccggagtgccccgacgaccagcgcgcctggaacatctgggaggtcgaggactacggcttcgggatcttcaccaccaacatctggctcaagctgcgggacagctacacccaggtgtgcgaccaccgcctgatgtccgccgccatcaaggacagcaaggcggtgcacgccgacatgggctactggatcgagtccgagaagaacgagacctggaagctcgcccgggccagcttcatcgaggtcaagacctgcatctggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcgacctctgcgagggcaccaccgtggtcgtggacgagcactgcggcaaccgggggccgtccctgcgcacgaccaccgtgaccggcaagatcatccacgagtggtgctgccggagctgcacgctgccgcccctgcgcttcaagggggaggacggctgctggtacgggatggagatccggcccgtcaaggagaaggaggagaacctggtgaagtccatggtgagcgcgggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacctggaacgacctgatccggctgtgcatcatggtcggcgccaacgccagcgaccgcatggggatgggcacgacgtacctcgccctgatggcgaccttcaagatgcgcccgatgttcgccgtggggctcctgttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggcgaccctcctgagcctgaccttcatcaagacgaccttctccctccactacgcctggaagaccatggccatggtcctgagcatcgtgtccctgttccccctctgcctgagcaccacgtcccagaagaccacctggctgcccgtgctcctgggcagcctggggtgcaagccgctcaccatgttcctgatcgccgagaacaagatctggggccgcaagtcctggcccctgaacgaggggatcatggccgtcggcatcgtgagcatcctcctgagctccctgctcaagaacgacgtgcccctggcggggcccctgatcgccggcggcatgctcatcgcctgctacgtcatcagcgggtccagcgccgacctgtccctggagaaggccgcggaggtgagctgggaggaggaggccgagcactccggcgccagccacaacatcctcgtggaggtccaggacgacgggacgatgaagatcaaggacgaggagcgggacgacaccctgaccatcctgctcaaggccaccctgctggccgtgtccggcgtgtacccgctcagcatccccgcgaccctgttcgtctggtacttctggcagaagaagaagcagcgctccggggtgctgtgggacacgccctccccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacaccggggaggaggtgcaggtcatcgccgtggagcccggcaagaaccccaagaacgtgcagacggcgcccgggaccttcaagaccagcgagggcgaggtcggcgccatcgccctcgacttcaagcccgggacctccggcagccccatcgtgaaccgcgaggggaagatcgtgggcctgtacggcaacggggtcgtgacgaccagcggcacctacgtgtccgccatcgcgcaggccaaggccagccaggaggggcccctgccggagatcgaggacgaggtcttccggaagcgcaacctcaccatcatggacctgcaccccggctccgggaagacgcggcgctacctgcccgccatcgtgcgggaggccatcaagcgcaagctccggaccctgatcctggcgccgacccgcgtggtcgccagcgagatggccgaggccctcaagggcatgcccatccgctaccagaccacggccgtgaagtccgagcacaccggcaaggagatcgtggacctgatgtgccacgcgaccttcaccatgcggctgctcagccccgtccgcgtgcccaactacaacatgatcatcatggacgaggcccacttcacggacccgtccagcatcgccgcccgggggtacatctccacccgcgtgggcatgggggaggccgcggccatcttcatgaccgccacgccgcccggcagcgtcgaggccttcccccagtccaacgcggtgatccaggacgaggagcgggacatcccggagcgcagctggaactccgggtacgagtggatcacggacttccccggcaagaccgtgtggttcgtccccagcatcaagtccggcaacgacatcgccaactgcctgcggaagaacgggaagcgcgtgatccagctgagccggaagaccttcgacaccgagtaccagaagacgaagaacaacgactgggactacgtggtcaccaccgacatctccgagatgggcgccaacttccgcgccgaccgggtgatcgacccccgccggtgcctcaagccggtgatcctgaaggacgggcccgagcgcgtcatcctggccggccccatgcccgtgaccgtcgcgagcgccgcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgccatcgacggggagtaccgcctgcgcggcgaggcccggaagaccttcgtggagctgatgcgccgcggggacctcccggtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcgcgcacgtacagcgaccccctggccctccgggagttcaaggagttcgccgccggccgccggtccgtcagcggggacctgatcctggagatcggcaagctcccccagcacctgacccagcgcgcgcagaacgccctggacaacctcgtgatgctgcacaactccgagcagggcgggcgggcctaccgccacgccatggaggagctgccggacaccatcgagaccctcatgctgctggccctcatcgcggtgctgacgggcggggtcaccctgttcttcctcagcggccgggggctgggcaagacctccatcggcctgctctgcgtgatggccagctccgtgctgctgtggatggccagcgtcgagccccactggatcgccgcctccatcatcctcgagttcttcctgatggtgctgctcatccccgagcccgaccgccagcggaccccgcaggacaaccagctggcgtacgtggtcatcgggctcctcttcatgatcctgaccgtggccgccaacgagatgggcctgctcgagacgaccaagaaggacctggggatcggccacgtggccgtcgagaaccaccaccacgccgcgatgctggacgtggacctccaccccgccagcgcctggaccctgtacgccgtggccaccacgatcatcacccccatgatgcgccacaccatcgagaacaccacggcgaacatctccctgaccgccatcgccaaccaggccgcgatcctcatggggctggacaagggctggccgatcagcaagatggacatcggcgtccccctgctcgccctggggtgctactcccaggtgaaccccctgaccctcaccgccgccgtgctgatgctggtcgcccactacgcgatcatcggccccgggctccaggccaaggccacgcgggaggcccagaagcgcaccgccgcgggcatcatgaagaacccgaccgtggacgggatcgtggccatcgacctggaccccgtcgtgtacgacaccaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgccgtgtccatggcgaacatcttccgggggagctacctcgccggcgccggcctggccttcagcctgatgaagtccctcgggggcgggcgccggggcaccggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagacgaccaagcacgccgtgagccgcggcaccgccaagctgcggtggttcgtggagcgcaacctcgtcaagccggaggggaaggtgatcgacctgggctgcggccgcggcgggtggtcctactactgcgccgggctgaagaaggtgaccgaggtcaaggggtacacgaagggcgggcccggccacgaggagcccatccccatggcgacctacgggtggaacctggtgaagctccacagcggcaaggacgtgttcttcatcccgcccgagaagtgcgacaccctgctgtgcgacatcggggagtccagccccaaccccaccatcgaggagggccgcacgctccgggtcctgaagatggtggagccgtggctgcgcgggaaccagttctgcatcaagatcctcaacccctacatgccctccgtggtcgagaccctggagcagatgcagcggaagcacggcggcatgctggtgcgcaaccccctcagccggaactccacccacgagatgtactgggtgagctgcgggaccggcaacatcgtctccgccgtgaacatgaccagccgcatgctgctgaaccggttcacgatggcccaccgcaagccgacctacgagcgcgacgtggacctcggggccggcacccggcacgtcgccgtggagcccgaggtggcgaacctggacatcatcggccagcgcatcgagaacatcaagcacgagcacaagtccacctggcactacgacgaggacaacccctacaagacgtgggcctaccacgggagctacgaggtcaagccctccggcagcgccagctccatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcgcagatcatggaggtcaccgccaagtggctgtggggcttcctgagccgcaacaagaagccgcggatctgcacccgcgaggagttcacccggaaggtgcgctccaacgccgccatcggcgcggtgttcgtcgacgagaaccagtggaacagcgccaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcaaccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtccgcgtgcagcggccggccaagaacgggaccgtgatggacgtcatcagccgccgcgaccagcggggctccggccaggtgggcacctacggcctgaacacgttcaccaacatggaggcccagctcatccgccagatggagagcgaggggatcttctcccccagcgagctggagacccccaacctggcgggccgggtgctcgactggctggagaagcacggggtcgagcgcctgaagcggatggccatctccggcgacgactgcgtggtgaagcccatcgacgaccgcttcgccaccgccctcacggccctgaacgacatggggaaggtccggaaggacatcccgcagtgggagcccagcaagggctggaacgactggcagcaggtccccttctgctcccaccacttccaccagctgatcatgaaggacggccgcgagatcgtggtcccctgccggaaccaggacgagctcgtggggcgcgcgcgggtgagccagggcgccgggtggagcctgcgcgagaccgcctgcctgggcaagtcctacgcccagatgtggcagctcatgtacttccaccggcgcgacctgcggctggcggccaacgccatctgcagcgccgtcccggtggactgggtgcccacctcccgcaccacgtggagcatccacgcccaccaccagtggatgaccaccgaggacatgctctccgtctggaaccgggtgtggatcgaggagaacccctggatggaggacaagacccacatcagctcctggggcgacgtgccctacctgggcaagcgcgaggaccagtggtgcggcagcctgatcgggctcacggcgcgggccacctgggccaccaacatccaggtcgccatcaaccaggtgcgccgcctgatcggcaacgagaactacctggactacatgacctccatgaagcggttcaagaacgagatcgacccggagggggccctctggtga

SEQ ID NO: 8776 - RNA, 9879 nt, synthetic construct
  misc_feature 1..9879: note = derived and/or modified CDS sequence (opt1) from DENV-1__EU482506__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcatcctgctcacctggctgggcctgaacagccgctccaccagcctctccatgacctgcatcgccgtcgggctggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgtggccggcatcctggcgcaggggaagaagatgatccggccccagcccatggagtacaagtactcctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctgaagctccgggactcctacacccaggtgtgcgaccaccgcctgatgagcgcggccatcaaggactccaaggccgtccacgccgacatgggctactggatcgagagcgagaagaacgagacctggaagctggcccgggcgtccttcatcgaggtgaagacgtgcatctggcccaagagccacaccctctggtccaacggcgtgctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtcgtggtggacgagcactgcggcaaccgggggccgagcctccgcaccaccacggtcaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtctccgccggcagcggcgaggtggacagcttctccctggggctgctctgcatcagcatcatcatcgaggaggtgatgcggtcccgctggagccggaagatgctgatgaccggcacgctggccgtcttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtgggcctgctgttccgccggctcaccagccgcgaggtcctgctgctcaccatcgggctgtccctggtggccagcgtggagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtcctctccatcgtgagcctgttccccctgtgcctctccaccaccagccagaagaccacgtggctgcccgtcctgctcggctccctggggtgcaagccgctgaccatgttcctcatcgcggagaacaagatctggggccggcgcagctggcccctgaacgaggggatcatggccgtgggcatcgtgtccatcctgctcagcagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggaccatgaagatcaaggacgaggagcgggacgacaccctcaccatcctgctgaaggcgacgctcctggccgtgagcggcgtctacccgctgtccatccccgccaccctcttcgtgtggtacttctggcagaagaagaagcagcgcagcggggtgctgtgggacacccccagcccgcccgaggtcgagcgggccgtgctggacgacggcatctaccgcatcatgcagcggggcctgctcgggcgcagccaggtgggcgtcggggtgttccaggagaacgtgttccacaccatgtggcacgtcacgcggggcgccgtgctgatgtaccaggggaagcgcctggagccctcctgggcgagcgtgaagaaggacctcatctcctacggcggcgggtggcggctgcagggcagctggaacaccggggaggaggtccaggtgatcgccgtggagcccggcaagaaccccaagaacgtccagaccgcccccgggaccttcaagacgcccgagggcgaggtgggcgccatcgccctggacttcaagcccgggacctccggcagccccatcgtgaaccgcgaggggaagatcgtcggcctctacggcaacggggtggtgaccacctccggcacgtacgtcagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtgcgggaggccatcaagcgcaagctgcgcaccctcatcctggcccccacgcgggtcgtggccagcgagatggccgaggcgctgaagggcatgcccatccgctaccagaccaccgccgtgaagtccgagcacaccggcaaggagatcgtcgacctcatgtgccacgccacgttcaccatgcggctgctgagccccgtgcgcgtgccgaactacaacatgatcatcatggacgaggcccacttcaccgacccctccagcatcgccgcgcgggggtacatctccacccgcgtcggcatgggggaggccgccgccatcttcatgacggccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctccggaagaacgggaagcgcgtgatccagctgagccggaagacgttcgacaccgagtaccagaagaccaagaacaacgactgggactacgtcgtgaccacggacatctccgagatgggcgccaacttccgcgcggaccgggtgatcgacccgcgccggtgcctgaagcccgtcatcctcaaggacgggcccgagcgcgtgatcctggccggccccatgccggtgaccgtcgccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtggagctgatgcgccgcggggacctgcccgtctggctcagctacaaggtggcctccgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtgatgctccacaactccgagcagggcgggcgggcctaccgccacgcgatggaggagctgcccgacacgatcgagaccctgatgctcctggccctgatcgccgtcctcaccggcggggtgaccctgttcttcctgagcggccgggggctcggcaagacctccatcggcctgctgtgcgtgatggccagctccgtcctcctgtggatggccagcgtggagccccactggatcgcggcctccatcatcctggagttcttcctcatggtgctgctgatccccgagccggaccgccagcggacgccccaggacaaccagctcgcctacgtcgtgatcgggctgctgttcatgatcctcaccgtggccgccaacgagatgggcctgctggagaccaccaagaaggacctcgggatcggccacgtcgcggtggagaaccaccaccacgccgccatgctggacgtggacctgcaccccgccagcgcctggacgctctacgcggtcgccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtgaaccccctgacgctgaccgccgcggtcctcatgctggtggcccactacgccatcatcggcccggggctgcaggccaaggccacccgcgaggcgcagaagcggaccgccgccggcatcatgaagaaccccacggtggacgggatcgtcgccatcgacctcgaccccgtggtgtacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtctccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtgagccgcggcaccgccaagctgcggtggttcgtcgagcgcaacctggtgaagcccgaggggaaggtgatcgacctgggctgcggccgcggcgggtggtcctactactgcgccgggctcaagaaggtcacggaggtgaaggggtacaccaagggcggccccggccacgaggagcccatcccgatggccacctacgggtggaacctggtgaagctgcacagcggcaaggacgtcttcttcatcccgcccgagaagtgcgacaccctcctgtgcgacatcggggagtccagccccaacccgacgatcgaggagggccgcaccctgcgggtgctcaagatggtggagccctggctgcgcgggaaccagttctgcatcaagatcctgaacccctacatgccctccgtcgtggagaccctcgagcagatgcagcggaagcacggcggcatgctggtgcgcaacccgctgagccggaactccacccacgagatgtactgggtcagctgcgggaccggcaacatcgtgtccgccgtgaacatgacgagccgcatgctcctgaaccgcttcaccatggcgcaccggaagcccacctacgagcgcgacgtcgacctgggggccggcacccggcacgtggccgtggagcccgaggtcgccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctctggggcttcctgagccgcaacaagaagccccggatctgcacccgcgaggagttcacgcggaaggtgcgctccaacgcggccatcggcgccgtcttcgtggacgagaaccagtggaacagcgccaaggaggcggtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggcccagctgatccggcagatggagtccgaggggatcttcagcccctccgagctcgagacccccaacctggccgagcgcgtcctggactggctcgagaagtacggcgtggagcggctgaagcgcatggccatcagcggggacgactgcgtggtcaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtcgtgccgtgccgcaaccaggacgagctggtgggccgggcccgcgtctcccagggggccggctggagcctccgggagaccgcgtgcctgggcaagagctacgcccagatgtggcagctgatgtacttccaccgccgggacctccgcctggccgccaacgcgatctgctccgccgtgcccgtggactggatccccaccagccggacgacctggtccatccacgcccaccaccagtggatgaccaccgaggacatgctgagcgtctggaaccgcgtgtggatcgaggagaacccctggatggaggacaagacgcacatctccagctggggcgacgtgccgtacctcgggaagcgcgaggaccagtggtgcggctccctgatcggcctgaccgcccgggccacctgggcgaccaacatccaggtcgccatcaaccaggtgcgccggctcatcgggaacgagaactacctggactacatgaccagcatgaagcgcttcaagaacgagggcgaccccgagggggccctgtggtga

SEQ ID NO: 8777 - RNA, 9879 nt, synthetic construct
  misc_feature 1..9879: note = derived and/or modified CDS sequence (opt1) from DENV-1__EU482509__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcctgacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgccgggaagctcgtgcaccagatcttcggcaccgcctacggggtcctgttcagcggcgtgtcctggacgatgaagatcgggatcggcgtgctgctcacctggctgggcctgaacagccgctccaccagcctctccatgacctgcatcgccgtcgggctggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgtggcgggcatcctggcccaggggaagaagatgatccggccccagcccatggagtacaagtactcctggaagtcctggggcaaggccaagatcatcggcgccgacgtccagaacaccaccttcatcatcgacgggcccaacaccccggagtgccccgacgaccagcgcgcgtggaacatctgggaggtggaggactacggcttcgggatcttcacgaccaacatctggctgaagctccgggactcctacacccaggtgtgcgaccaccgcctgatgagcgccgccatcaaggactccaaggccgtccacgccgacatgggctactggatcgagagcgagaagaacgagacctggaagctggcgcgggcctccttcatcgaggtgaagacgtgcatctggcccaagagccacaccctctggtccaacggcgtgctggagagcgagatgatcgtccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatcatcgaggaggtcatgcggtcccgctggagccggaagatgctgatgaccggcacgctggccgtgttcttcctcctgatcatggggcagctgacctggaacgacctcatccgcctgtgcatcatggtgggcgcgaacgcctccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggcgagcgtcgagctccccaactccctggaggagctgggcgacgggctcgccatgggcatcatgatcctgaagctgctcaccgacttccagagccaccagctgtgggccacgctgctctccctgaccttcatcaagaccaccttcagcctgcactacgcctggaagacgatggcgatggtgctctccatcgtcagcctgttccccctgtgcctctccaccaccagccagaagaccacgtggctgcccgtgctgctcggctccctggggtgcaagccgctgaccatgttcctcatcgccgagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagaaggccgccgaggtctcctgggaggaggaggccgagcacagcggcgcgtcccacaacatcctggtggaggtgcaggacgacgggaccatgaagatcaaggacgaggagcgggacgacaccctcaccatcctgctgaaggccacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgcggtgctgatgtaccaggggaagcgcctggagccctcctgggccagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgcgctggacttcaagcccgggacctccggcagccccatcgtcaaccgcgaggggaagatcgtgggcctctacggcaacggggtggtcaccacctccggcacgtacgtgagcgccatcgcccaggccaaggcgagccaggaggggccgctgcccgagatcgaggacgaggtgttccggaagcgcaacctgaccatcatggacctccaccccggctccgggaagacccggcgctacctgccggccatcgtccgggaggccatcaagcgcaagctgcgcaccctcatcctggcccccacgcgggtggtggccagcgagatggcggaggccctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgcggcccgggggtacatctccacccgcgtgggcatgggggaggccgccgccatcttcatgacggcgacgccgcccggcagcgtggaggccttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgcgaacttccgcgccgaccgggtcatcgacccgcgccggtgcctgaagcccgtgatcctcaaggacgggcccgagcgcgtgatcctggccggccccatgccggtcaccgtggccagcgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgcggccggccgccggtccgtgagcggggacctcatcctggagatcggcaagctgccgcagcacctcacccagcgcgcccagaacgccctggacaacctggtcatgctccacaactccgagcagggcgggcgggcgtaccgccacgccatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggcgagcgtggagccccactggatcgccgcctccatcatcctggagttcttcctcatggtcctgctgatccccgagccggaccgccagcggacgccccaggacaaccagctcgcctacgtggtgatcgggctgctgttcatgatcctcaccgtcgccgcgaacgagatgggcctgctggagaccaccaagaaggacctcgggatcggccacgtggccgtggagaaccaccaccacgccgccatgctggacgtcgacctgcaccccgccagcgcgtggacgctctacgccgtggccaccaccatcatcaccccgatgatgcgccacacgatcgagaacaccaccgccaacatctccctgaccgccatcgcgaaccaggccgccatcctgatggggctcgacaagggctggcccatcagcaagatggacatcggcgtgcccctgctggccctcgggtgctactcccaggtcaaccccctgacgctgaccgcggccgtgctcatgctggtggcccactacgccatcatcggcccggggctgcaggccaaggcgacccgcgaggcccagaagcggaccgccgccggcatcatgaagaaccccacggtcgacgggatcgtggccatcgacctcgaccccgtggtctacgacgcgaagttcgagaagcagctgggccagatcatgctgctcatcctgtgcaccagccagatcctgctcatgcgcaccacctgggccctgtgcgagtccatcacgctggccaccggccccctcaccaccctgtgggaggggagcccgggcaagttctggaacacgaccatcgccgtgtccatggccaacatcttccgggggagctacctggcgggcgccggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggcgaaggagggcctcaagcgcggggagaccaccaagcacgccgtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgcggtcaacatgacgagccgcatgctcctgaaccgcttcaccatggcccaccggaagcccacctacgagcgcgacgtggacctgggggccggcacccggcacgtggccgtcgagcccgaggtggccaacctcgacatcatcggccagcgcatcgagaacatcaagcacgagcacaagtccacgtggcactacgacgaggacaacccctacaagacctgggcgtaccacgggagctacgaggtgaagccgtccggcagcgcctccagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgcgaagtggctctggggcttcctgagccgcaacaagaagccccggatctgcacccgcgaggagttcacgcggaaggtccgctccaacgccgccatcggcgccgtgttcgtggacgagaaccagtggaacagcgcgaaggaggccgtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgcgctgctggccaagagcatcttcaagctcacctaccagaacaaggtggtgcgcgtccagcggcccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagacccccaacctggccgagcgcgtgctggactggctcgagaagtacggcgtggagcggctgaagcgcatggcgatcagcggggacgactgcgtcgtgaagccgatcgacgaccggttcgccacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggcgggctggagcctccgggagaccgcctgcctgggcaagagctacgcccagatgtggcagctgatgtacttccaccgccgggacctccgcctggccgcgaacgccatctgctccgccgtgcccgtcgactggatccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgcgaggaccagtggtgcggctccctgatcggcctgaccgcccgggcgacctgggccaccaacatccaggtggccatcaaccaggtgcgccggctcatcgggaacgagaactacctggactacatgaccagcatgaagcgcttcaagaacgagggcgagcccgagggggccctgtggtga

SEQ ID NO: 8778 - RNA, 9879 nt, synthetic construct
  misc_feature 1..9879: note = derived and/or modified CDS sequence (opt1) from DENV-1__EU482510__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggtggagcccgacgacgtggactgctggtgcaacaccacggacacctgggtgacctacgggacctgcagccagacgggcgagcaccggcgcgacaagcggagcgtggccctcgcgccccacgtcggcctggggctggagacccgcgccgagacctggatgagctccgagggcgcgtggaagcagatccagaaggtggagacctgggccctccggcaccccgggttcacggtgatcgccctgttcctggcccacgcgatcggcaccagcatcacccagaaggggatcatcttcatcctcctgatgctggtcaccccctccatggccatgcgctgcgtgggcatcggcagccgggacttcgtggaggggctctccggcgccacgtgggtcgacgtggtgctggagcacgggagctgcgtcaccaccatggccaaggacaagcccaccctggacatcgagctcctgcgcacggaggtgaccaaccccgccgtgctgcggaagctctgcatcgaggcgaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgccaccatcacgccccaggcgcccacgagcgagatccagctcaccgactacggggccctgaccctggactgcagcccccggaccggcctcgacttcaacgagatggtgctgctgacgatgaaggagaagtcctggctcgtgcacaagcagtggttcctggacctgcccctcccctggaccagcggggcctccaccagccaggagacctggaaccggcaggacctgctggtcacgttcaagaccgcccacgccaagaagcaggaggtggtggtcctcggctcccaggagggcgcgatgcacaccgccctgaccggggccacggagatccagaccagcggcaccaccacgatcttcgccgggcacctgaagtgccgcctcaagatggacaagctgaccctgaagggcatgtcctacgtgatgtgcaccgggagcttcaagctcgagaaggaggtggccgagacccagcacggcacggtcctggtgcagatcaagtacgagggcaccgacgcgccctgcaagatccccttctccacccaggacgggaagggcgtgacccagaacgggcggctgatcacggccaacccgatcgtcaccgacaaggagaagcccgtgaacatcgaggccgagccgcccttcggcgagagctacatcgtgatcggcgccggggagaaggcgctgaagctctcctggttcaagaagggcagctccatcgggaagatgttcgaggccaccgcccgcggcgcccggcgcatggccatcctgggggacaccgcgtgggacttcggcagcatcggcggggtcttcacgtccgtgggcaagctggtgcaccagatcttcgggaccgcctacggcgtcctcttcagcggggtgtcctggaccatgaagatcggcatcggcgtgctgctgacctggctcgggctgaacagccgctccacgagcctgtccatgacctgcatcgccgtcggcctcgtgaccctgtacctgggggtgatggtccaggccgacagcggctgcgtgatcaactggaaggggcgggagctcaagtgcggcagcggcatcttcgtgaccaacgaggtccacacgtggaccgagcagtacaagttccaggccgactccccgaagcgcctgagcgcggccatcgggaaggcctgggaggagggcgtgtgcgggatccggtccgccacccgcctggagaacatcatgtggcggcagatcagcaacgagctcaaccacatcctgctggagaacgacatgaagttcaccgtggtcgtgggcgacgtggtcgggatcctcgcccagggcaagaagatgatccgcccccagcccatggagcacaagtactcctggaagtcctggggcaaggcgaagatcatcggggccgacgtgcagaacaccacgttcatcatcgacggccccaacaccccggagtgccccgacgaccagcgggcctggaacatctgggaggtggaggactacgggttcggcatcttcaccaccaacatctggctgaagctgcgcgactcctacacgcaggtctgcgaccaccggctcatgagcgccgcgatcaaggactccaaggccgtgcacgccgacatgggctactggatcgagagcgagaagaacgagacctggaagctggcccgcgcctccttcatcgaggtgaagacctgcatctggcccaagagccacaccctgtggtccaacggggtcctcgagagcgagatgatcatccccaagatctacggcgggccgatctcccagcacaactaccggcccggctacttcacgcagaccgcggggccctggcacctgggcaagctggagctcgacttcgacctgtgcgagggcaccaccgtggtggtcgacgagcactgcgggaaccgcggcccgagcctgcggacgaccaccgtgaccgggaagatcatccacgagtggtgctgccgctcctgcacgctgccgcccctccggttcaagggcgaggacgggtgctggtacggcatggagatccgccccgtgaaggagaaggaggagaacctggtcaagagcatggtgagcgccggctccggggaggtggacagcttctccctcggcctgctgtgcatcagcatcatgatcgaggaggtcatgcggtcccgctggagccggaagatgctcatgaccgggaccctggccgtgttcttcctgctcatcatgggccagctgacctggaacgacctgatccgctcctgcatcatggtgggggccaacgccagcgaccgcatgggcatgggcacgacctacctcgcgctgatggccaccttcaagatgcggccgatgttcgccgtcgggctcctgttccgccggctgacctcccgcgaggtgctgctcctgacgatcggcctgagcctcgtcgcctccgtggagctgcccaacagcctggaggagctcggggacggcctggccatgggcatcatgatcctgaagctcctgaccgacttccagtcctaccagctgtgggcgaccctcctgagcctgaccttcatcaagacgaccttctccctccactacgcctggaagaccatggccatggtgctgagcatcgtctccctgctccccctgtgcctgagcaccacgtcccagaagaccacctggctccccgtgctgctggggagcctcggctgcaagccgctgaccatgttcctgatcgccgagaacaagatctgggggcgcaagagctggcccctcaacgagggcatcatggcggtggggatcgtctccatcctgctgagctccctcctgaagaacgacgtgcccctggccggccccctcatcgccggcgggatgctgatcgcctgctacgtgatcagcggctccagcgccgacctgtccctcgagaaggcggccgaggtcagctgggaggaggaggccgagcactccggggccagccacaacatcctggtggaggtgcaggacgacggcacgatgaagatcaaggacgaggagcgcgacgacaccctgaccatcctcctgaaggccaccctgctcgcggtctccggggtgtacccgctgagcatccccgccaccctgttcgtgtggtacttctggcagaagaagaagcagcggtccggcgtcctctgggacacgcccagcccgcccgaggtggagcgcgccgtgctggacgacggcatctaccggatcatgcagcgcgggctgctgggccggtcccaggtcggggtgggcgtgttccaggagaacgtcttccacaccatgtggcacgtgacccgcggggccgtgctcatgtaccagggcaagcggctggagcccagctgggcctccgtcaagaaggacctgatcagctacggcgggggctggcgcctccaggggtcctggaacaccggcgaggaggtccaggtgatcgcggtcgagcccgggaagaaccccaagaacgtgcagacggcccccggcaccttcaagacccccgagggcgaggtgggggccatcgccctggacttcaagcccggcaccagcgggagccccatcgtcaaccgggagggcaagatcgtgggcctgtacgggaacggcgtggtcacgacctccgggacctacgtgagcgccatcgcgcaggccaaggcctcccaggagggcccgctccccgagatcgaggacgaggtgttccgcaagcggaacctgaccatcatggacctgcaccccgggagcggcaagacgcgccggtacctcccggccatcgtccgcgaggcgatcaagcggaagctgcgcaccctgatcctcgcccccacccgcgtggtggcctccgagatggccgaggccctgaagggcatgcccatccggtaccagaccacggcggtcaagagcgagcacaccgggcgcgagatcgtggacctgatgtgccacgccaccttcaccatgcggctcctgtcccccgtgcgcgtcccgaactacaacatgatcatcatggacgaggcccacttcacggaccccagctccatcgccgcccggggctacatcagcacccgcgtggggatgggcgaggcggccgccatcttcatgaccgccacgccgcccgggtccgtggaggccttcccgcagagcaacgcggtcatccaggacgaggagcgggacatccccgagcgctcctggaacagcggctacgagtggatcacggacttccccggcaagaccgtgtggttcgtgccctccatcaagagcgggaacgacatcgccaactgcctgcggaagaacggcaagcgcgtcatccagctctcccggaagaccttcgacaccgagtaccagaagacgaagaacaacgactgggactacgtggtgaccaccgacatcagcgagatgggggccaacttccgcgccgaccgggtcatcgacccgcgccggtgcctgaagcccgtgatcctgaaggacggccccgagcgcgtcatcctcgcggggcccatgccggtgaccgtggcctccgccgcccagcggcgcggccggatcggccgcaaccacaacaaggagggggaccagtacatctacatgggccagcccctgaacaacgacgaggaccacgcccactggacggaggcgaagatgctgctcgacaacatcaacacccccgaggggatcatccccgccctgttcgagccggagcgcgagaagtccgccgccatcgacggcgagtaccggctgcgcggggaggcccggaagaccttcgtcgagctcatgcgccggggcgacctgcccgtgtggctgagctacaaggtggcgtccgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacgtactccgaccccctcgccctgcgggagttcaaggagttcgccgccgggcgccggagcgtgtccggcgacctgatcctcgagatcggcaagctgccgcagcacctgacccagcgcgcgcagaacgccctcgacaacctggtcatgctgcacaacagcgagcagggcgggcgggcctaccgccacgccatggaggagctccccgacaccatcgagaccctgatgctgctcgcgctgatcgccgtgctgaccggcggggtgaccctcttcttcctgtccgggcgggggctgggcaagaccagcatcgggctcctgtgcgtcatggcctccagcgccctgctctggatcgcctccgtggagccccactggatcgcggccagcatcatcctggagttcttcctgatggtgctcctgatccccgagccggaccgccagcggacgccccaggacaaccagctggcctacgtcgtgatcggcctcctgttcatgatcctgaccgtggccgccaacgagatggggctcctggagacgaccaagaaggacctgggcatcgggcacgtcgcggtggagaaccaccaccacgccaccatgctcgacgtggacctgcaccccgcctccgcctggaccctgtacgccgtcgcgacgaccatcatcaccccgatgatgcgccacaccatcgagaacacgaccgccaacatcagcctcaccgccatcgccaaccaggccgcgatcctgatgggcctggacaagggctggcccatctccaagatggacatcggggtgcccctcctggccctgggctgctacagccaggtgaaccccctcaccctgacggccgccgtcctgatgctcgtggcgcactacgccatcatcgggccgggcctgcaggccaaggccacccgcgaggcccagaagcggaccgcggccgggatcatgaagaaccccaccgtggacggcatcgtcgccatcgacctggaccccgtggtgtacgacgccaagttcgagaagcagctcggccagatcatgctgctgatcctctgcacgtcccagatcctgctgatgcgcaccacctgggccctctgcgagagcatcaccctggcgacggggcccctgaccaccctctgggagggctccccggggaagttctggaacaccacgatcgccgtcagcatggccaacatcttccggggcagctacctggccggcgccgggctggcgttctccctcatgaagtccctgggcgggggccgccgggggaccggcgcccagggcgagaccctgggggagaagtggaagcgccagctcaaccagctgtccaagagcgagttcaacacctacaagcggtccggcatcatggaggtggaccgcagcgaggccaaggaggggctgcggcgcggcgagacgaccaagcacgccgtgtcccgggggaccgcgaagctccgctggttcgtcgagcggaacctggtgaagcccgagggcaaggtgatcgacctgggctgcgggcgcggcgggtggagctactactgcgccggcctgaagaaggtcaccgaggtgaaggggtacacgaagggcggccccgggcacgaggagcccatcccgatggccacctacggctggaacctcgtgaagctgcactccgggaaggacgtcttcttcatcccgcccgagaagtgcgacaccctgctctgcgacatcggcgagagctcccccaacccgaccatcgaggaggggcggacgctgcgcgtgctgaagatggtggagccctggctccggggcaaccagttctgcatcaagatcctgaacccctacatgcccagcgtcgtggagaccctggagcagatgcagcgcaagtacggcgggatgctcgtgcggaacccgctgtcccgcaacagcacccacgagatgtactgggtctcctgcggcaccgggaacatcgtgagcgccgtgaacatgacctcccgcatgctgctcaaccggttcacgatggcccaccgcaagcccacctacgagcgggacgtcgacctgggcgcgggcacccgccacgtggccgtggagcccgaggtcgccaacctggacatcatcgggcagcggatcgagaacatcaagcacgagcacaagagcacctggcactacgacgaggacaacccctacaagacgtgggcctaccacggctcctacgaggtgaagccgagcgggagcgcctccagcatggtcaacggcgtggtgaagctcctgaccaagccctgggacgtcatccccatggtgacccagatcgcgatgaccgacacgacccccttcgggcagcagcgcgtgttcaaggagaaggtcgacacccggaccccgaaggccaagcgcggcacggcccagatcatggaggtgaccgcccggtggctgtggggcttcctctcccgcaacaagaagccccggatctgcacccgcgaggagttcacccggaaggtgcgcagcaacgccgcgatcggggccgtcttcgtggacgagaaccagtggaactccgccaaggaggccgtggaggacgagcggttctgggacctggtccaccgcgagcgggagctgcacaagcagggcaagtgcgcgacgtgcgtgtacaacatgatggggaagcgcgagaagaagctcggcgagttcgggaaggccaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgcggacgacaccgccgggtgggacacccgcatcaccgaggacgacctgcagaacgaggccaagatcacggacatcatggagccggagcacgccctcctggccacctccatcttcaagctgacctaccagaacaaggtcgtgcgggtgcagcgccccgcgaagaacggcaccgtcatggacgtgatcagccggcgcgaccagcgggggtccggccaggtgggcacgtacgggctcaacaccttcaccaacatggaggcccagctgatccgccagatggagagcgagggcatcttctcccccagcgagctggagacccccaacctcgccgagcgggtcctggactggctggagaagtacggggtggagcgcctcaagcggatggccatctccggcgacgactgcgtggtcaagccgatcgacgaccgcttcgccacggcgctgaccgccctgaacgacatggggaaggtgcggaaggacatcccccagtgggagcccagcaagggctggaacgactggcagcaggtccccttctgcagccaccacttccaccagctcatcatgaaggacggccgcgagatcgtcgtgccgtgccggaaccaggacgagctggtggggcgcgcccgggtctcccagggcgccgggtggagcctgcgcgagaccgcctgcctcggcaagtcctacgcgcagatgtggcagctgatgtacttccaccggcgcgacctgcggctcgccgccaacgccatctgcagcgcggtgcccgtggactgggtccccacctcccgcacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctgggcaagcgggaggaccagtggtgcggcagcctcatcgggctgaccgcccgcgccacctgggccaccaacatccaggtggcgatcaaccaggtgcggcgcctgatcggcaacgagaactacctcgactacatgacctccatgaagcggttcaagaacgagagcgaccccgagggggccctgtggtga

SEQ ID NO: 8779 - RNA, 9879 nt, synthetic construct
  misc_feature 1..9879: note = derived and/or modified CDS sequence (opt1) from DENV-1__EU482511__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatgagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccaagcgcgtgctggactggctcgagaagtacggcgtggagcggctgaagcgcatggccatctccggggacgactgcgtcgtgaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8780 - RNA, 9879 nt, synthetic construct
  misc_feature 1..9879: note = derived and/or modified CDS sequence (opt1) from DENV-1__EU482513__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtggagcggctgaagcgcatggccatctccggggacgactgcgtcgtgaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8781 - RNA, 9879 nt, synthetic construct
  misc_feature 1..9879: note = derived and/or modified CDS sequence (opt1) from DENV-1__EU482515__SS-prME
  source 1..9879: mol_type = other RNA
agcgtgaccaccctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtcacctacgggacctgcagccagaccggcgagcaccggcgcgacaagcggtccgtggccctcgcgccccacgtgggcctggggctggagacccgcaccgagacgtggatgagctccgagggcgcctggaagcagatccagcgggtcgagacctgggccctccgccaccccgggttcaccgtgatcgccctgttcctggcccacgcgatcggcaccagcatcacgcagaaggggatcatcttcatcctcctgatgctggtgaccccctccatggccatgcggtgcgtcggcatcggcagccgcgacttcgtggaggggctctccggcgccacctgggtggacgtcgtgctggagcacgggagctgcgtgaccacgatggccaaggacaagcccaccctggacatcgagctcctgaagaccgaggtcaccaaccccgccgtgctgcggaagctctgcatcgaggcgaagatctccaacacgaccaccgacagccgctgcccgacccagggcgaggccacgctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgacggtccacaccggcgaccagcaccaggtggggaacgagtccaccgagcacggcaccaccgccacgatcacgccccaggcgcccaccaccgagatccagctcacggactacggggccctgaccctggactgcagcccccgcaccggcctcgacttcaacgagatggtcctgctgaccatgaaggagaagtcctggctcgtgcacaagcagtggttcctggacctgcccctcccctggacgagcggggccagcacctcccaggagacctggaaccggcaggacctgctggtgaccttcaagacggcccacgccaagaagcaggaggtcgtggtgctcggcagccaggagggcgcgatgcacaccgccctgaccggggccaccgagatccagacgtccggcaccaccaccatcttcgccgggcacctgaagtgccgcctcaagatggacaagctgacgctgaagggcatgagctacgtcatgtgcaccgggtccttcaagctcgagaaggagctggccgagacccagcacggcaccgtgctggtgcagatcaagtacgagggcacggacgcgccctgcaagatccccttcagcacccaggacgagaagggggtcacccagaacggccggctgatcaccgccaacccgatcgtgacggacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccaccgcccgcggggcccggcgcatggccatcctgggcgacaccgcgtgggacttcgggtccatcggcggcgtgttcaccagcgtggggaagctcgtccaccagatcttcggcacggcctacggggtgctgttctccggcgtgagctggaccatgaagatcgggatcggcgtcctgctcacctggctgggcctgaactcccgcagcacctccctcagcatgacgtgcatcgccgtggggctggtgaccctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacgcgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagctccgggacagctacacccaggtctgcgaccaccgcctgatgtccgcggccatcaaggacagcaaggccgtgcacgccgacatgggctactggatcgagtccgagaagaacgagacgtggaagctggcccgggcgagcttcatcgaggtgaagacctgcatctggcccaagtcccacaccctctggagcaacggcgtcctggagtccgagatgatcatccccaagatctacgggggcccgatgagccagcacaactaccgccccgggtacttcacccagacggccggcccctggcacctggggaagctcgagctggacttcgacctgtgcgagggcaccaccgtggtggtcgacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtccaagaagatgctgatgacgggcaccctggccgtgttcttcctcctgatcatggggcagctgacctggaacgacctcatccggctgtgcatcatggtgggcgccaacgcgagcgaccgcatggggatgggcaccacgtacctggccctcatggccaccttcaagatgcgcccgatgttcgccgtcggcctgctgttccggcgcctcacctcccgggaggtgctgctgctcaccatcgggctgagcctggtggcctccgtcgagctccccaacagcctggaggagctgggcgacgggctcgcgatgggcatcatgatcctgaagctgctcacggacttccagtcccaccagctgtgggccaccctgctcagcctgaccttcatcaagaccacgttctccctgcactacgcctggaagaccatggccatggtgctcagcatcgtctccctgttccccctgtgcctcagcaccacctcccagaagacgacctggctgcccgtgctgctcggcagcctggggtgcaagccgctgaccatgttcctcatcgcggagaacaagatctggggccgccggtcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgcgacgacaccctcacgatcctgctgaaggcgaccctcctggccgtctccggcgtgtacccgctgagcatccccgccaccctcttcgtgtggtacttctggcagaagaagaagcagcggtccggggtcctgtgggacacccccagcccgcccgaggtggagcgcgccgtgctggacgacggcatctaccggatcatgcagcgcggcctgctcgggcggtcccaggtcggcgtgggggtgttccaggagaacgtcttccacacgatgtggcacgtgacccgcggcgccgtgctgatgtaccaggggaagcggctggagcccagctgggcgtccgtcaagaaggacctcatcagctacggcggcgggtggcgcctgcagggctcctggaacaccggggaggaggtccaggtgatcgccgtcgagcccggcaagaaccccaagaacgtgcagaccgcccccgggacgttcaagacccccgagggcgaggtgggcgccatcgccctggacttcaagcccgggaccagcggctcccccatcgtcaaccgggaggggaagatcgtgggcctctacggcaacggggtggtcaccacgagcggcacctacgtgagcgcgatcgcccaggccaaggcctcccaggaggggccgctgcccgagatcgaggacgaggtgttccgcaagcggaacctgaccatcatggacctccaccccggcagcgggaagacccgccggtacctgccggcgatcgtccgcgaggccatcaagcggaagctgcgcacgctcatcctggcccccacccgcgtggtggcctccgagatggccgaggcgctgaagggcatgcccatccggtaccagaccaccgccgtcaagagcgagcacacgggcaaggagatcgtggacctcatgtgccacgccaccttcaccatgcgcctgctgtcccccgtgcgggtcccgaactacaacatgatcatcatggacgaggcccacttcaccgaccccagctccatcgccgcgcgcgggtacatcagcacgcgggtgggcatgggggaggccgccgccatcttcatgaccgccacgccgcccggctccgtggaggcgttcccgcagagcaacgccgtcatccaggacgaggagcgcgacatccccgagcggtcctggaacagcgggtacgagtggatcaccgacttccccggcaagacggtgtggttcgtgccctccatcaagagcggcaacgacatcgccaactgcctccgcaagaacgggaagcgggtcatccagctgtcccgcaagaccttcgacaccgagtaccagaagaccaagaacaacgactgggactacgtggtgacgaccgacatcagcgagatgggcgccaacttccgggcggaccgcgtcatcgacccgcggcgctgcctgaagcccgtgatcctcaaggacgggcccgagcgggtgatcctggccggccccatgccggtcaccgtggcctccgccgcccagcgccgggggcgcatcggccggaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgcgagaagtccgccgccatcgacggggagtaccgcctccggggcgaggcgcgcaagaccttcgtcgagctgatgcggcgcggggacctgcccgtgtggctctcctacaaggtggccagcgagggcttccagtacagcgaccggcgctggtgcttcgacggcgagcggaacaaccaggtcctggaggagaacatggacgtggagatctggaccaaggagggggagcgcaagaagctgcggccccgctggctcgacgcccggacctactccgaccccctggccctgcgcgagttcaaggagttcgccgcgggccggcgcagcgtgtccggggacctcatcctggagatcggcaagctgccgcagcacctcacgcagcgggcccagaacgccctggacaacctggtcatgctccacaacagcgagcagggcgggcgcgcctaccggcacgcgatggaggagctgcccgacaccatcgagaccctgatgctcctggccctgatcgccgtgctcaccggcggggtgaccctgttcttcctgtccggccgcgggctcggcaagacgagcatcggcctgctgtgcgtcatggcctccagcgtgctcctgtggatggcctccgtggagccccactggatcgcggccagcatcatcctggagttcttcctcatggtcctgctgatccccgagccggaccggcagcgcacgccccaggacaaccagctcgcctacgtggtgatcgggctgctgttcatgatcctcaccgtcgccgccaacgagatgggcctgctggagaccacgaagaaggacctcgggatcggccacgtggcggtggagaaccaccaccacgccgccatgctggacgtcgacctgcaccccgcctccgcctggaccctctacgcggtggccaccaccatcatcacgccgatgatgcggcacaccatcgagaacaccaccgccaacatcagcctgacggccatcgccaaccaggcggccatcctgatggggctcgacaagggctggcccatctccaagatggacatcggcgtgcccctgctggccctcgggtgctacagccaggtcaaccccctgaccctgaccgccgcggtgctcatgctggtggcccactacgccatcatcggcccggggctgcaggccaaggccacccgcgaggcgcagaagcgcacggccgccggcatcatgaagaaccccaccgtcgacgggatcgtggccatcgacctcgaccccgtggtctacgacgccaagttcgagaagcagctgggccagatcatgctgctcatcctgtgcacctcccagatcctgctcatgcggaccacgtgggcgctgtgcgagagcatcaccctggccaccggccccctcaccacgctgtgggaggggtccccgggcaagttctggaacaccaccatcgccgtgagcatggccaacatcttccgcgggtcctacctggccggcgcgggcctcgccttcagcctgatgaagtccctcgggggcgggcggcgcgggaccggggcccagggcgagacgctcggcgagaagtggaagcggcagctgaaccagctgtccaagagcgagttcaacacctacaagcgctccgggatcatggaggtggaccggagcgaggccaaggagggcctcaagcgcggggagaccaccaagcacgcggtctcccggggcacggccaagctgcgctggttcgtggagcggaacctggtgaagcccgaggggaaggtcatcgacctgggctgcggccgcgggggctggagctactactgcgccgggctcaagaaggtgaccgaggtgaagggctacaccaagggcggccccggccacgaggagcccatcccgatggccacctacgggtggaacctggtcaagctgcactccggcaaggacgtgttcttcatcccgcccgagaagtgcgacacgctcctgtgcgacatcggggagagctcccccaacccgaccatcgaggagggccggaccctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggacgggcaacatcgtgagcgccgtcaacatgacctcccggatgctcctgaaccgcttcaccatggcgcaccgcaagcccacctacgagcgggacgtggacctgggggccggcacgcgccacgtggccgtcgagcccgaggtggccaacctcgacatcatcggccagcggatcgagaacatcaagcacgagcacaagagcacctggcactacgacgaggacaacccctacaagacctgggcctaccacgggtcctacgaggtgaagccgagcggctccgcgagcagcatggtcaacggggtggtcaagctgctgaccaagccctgggacgtgatccccatggtgacgcagatcgccatgaccgacaccacccccttcggccagcagcgcgtcttcaaggagaaggtggacacgcggaccccgaaggccaagcgcgggaccgcccagatcatggaggtgaccgccaagtggctctggggcttcctgtcccggaacaagaagccccgcatctgcacgcgggaggagttcacccgcaaggtccggagcaacgcggccatcggcgccgtgttcgtggacgagaaccagtggaactccgccaaggaggcggtcgaggacgagcgcttctgggacctggtgcaccgggagcgcgagctccacaagcaggggaagtgcgcgacctgcgtgtacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtcgagggcgaggggctccacaagctgggctacatcctgcgggacatcagcaagatccccgggggcaacatgtacgccgacgacaccgccggctgggacacgcgcatcaccgaggacgacctccagaacgaggcccggatcaccgacatcatggagccggagcacgccctgctggcgaagtccatcttcaagctcacctaccagaacaaggtggtgcgcgtccagcgccccgccaagaacgggacggtgatggacgtgatcagccggcgcgaccagcggggctccgggcaggtcggcacctacggcctgaacaccttcaccaacatggaggcccagctgatccgccagatggagagcgaggggatcttctcccccagcgagctcgagacgcccaacctggccaagcgggtgctggactggctcgagaagtacggcgtggagcgcctgaagcggatggccatctccggggacgactgcgtcgtgaagccgatcgacgaccgcttcgcgaccgccctgaccgccctcaacgacatgggcaaggtgcggaaggacatcccccagtgggagcccagcaaggggtggaacgactggcagcaggtccccttctgctcccaccacttccaccagctgatcatgaaggacggccgcgagatcgtggtgccgtgccggaaccaggacgagctggtcggccgcgcccgggtgagccagggggccggctggagcctccgcgagaccgcgtgcctggggaagtcctacgcccagatgtggcagctgatgtacttccaccggcgcgacctccggctggccgccaacgcgatctgcagcgccgtgcccgtcgactggatccccacgtcccgcaccacctggagcatccacgcccaccaccagtggatgaccacggaggacatgctgtccgtgtggaaccgggtgtggatcgaggagaacccctggatggaggacaagacccacatcagctcctggggcgacgtcccgtacctcgggaagcgcgaggaccagtggtgcggcagcctgatcggcctgaccgcccgcgccacctgggcgaccaacatccaggtggccatcaaccaggtgcggcgcctcatcgggaacgagaactacctggactacatgacgtccatgaagcggttcaagaacgagagcgaccccgagggcgccctgtggtga

SEQ ID NO: 8782 - RNA, 9879 nt, synthetic construct
  misc_feature 1..9879: note = derived and/or modified CDS sequence (opt1) from DENV-1__EU482516__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccctgtccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgacgctcctggccgtgtccggcgtgtacccgctgagcatccccgccaccctcttcgtctggtacttctggcagaagaagaagcagcgctccggggtgctgtgggacacccccagcccgcccgaggtgggccgggccgtcctggacgacggcatctaccgcatcatgcagcgggggctgctcggccgctcccaggtgggggtgggcgtcttccaggagaacgtgttccacaccatgtggcacgtgacgcgcggggccgtcctgatgtaccagggcaagcgcctggagcccagctgggcgtccgtgaagaaggacctcatcagctacggcgggggctggcggctgcaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctctacgggaacggcgtcgtgaccaccagcgggacgtacgtgagcgcgatcgcccaggccaaggcctcccaggagggcccgctgcccgagatcgaggacgaggtcttccggaagcgcaacctgaccatcatggacctccaccccgggagcggcaagacccggcgctacctgccggcgatcgtgcgggaggccatcaagcgcaagctgcgcaccctcatcctggcccccacgcgggtggtcgcctccgagatggccgaggcgctgaagggcatgcccatccgctaccagaccaccgccgtcaagagcgagcacaccgggaaggagatcgtggacctcatgtgccacgccacgttcaccatgcggctgctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctccggaagaacggcaagcgcgtgatccagctgtcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctcaaggacggccccgagcgcgtcatcctggccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccatcgacggcgagtaccggctccgcggggaggcgcggaagacgttcgtggagctgatgcgccggggcgacctgcccgtgtggctctcctacaaggtcgccagcgagggcttccagtacagcgaccgccggtggtgcttcgacggggagcgcaacaaccaggtgctggaggagaacatggacgtggagatctggaccaaggagggcgagcggaagaagctgcgcccccggtggctcgacgcccgcacctactccgaccccctggccctgcgggagttcaaggagttcgccgcggggcgccggagcgtctccggcgacctcatcctggagatcggcaagctgccgcagcacctcacccagcgcgcccagaacgccctggacaacctggtgatgctccacaacagcgagcagggcgggcgggcctaccgccacgcgatggaggagctgcccgacacgatcgagaccctgatgctcctggccctgatcgccgtgctcaccgggggcgtcaccctgttcttcctgtccgggcggggcctcggcaagaccagcatcgggctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcggcctgctgttcatgatcctcaccgtggccgccaacgagatggggctgctggagaccaccaagaaggacctcggcatcgggcacgtggcggtcgagaaccaccaccacgccgccatgctggacgtggacctgcaccccgcctccgcctggacgctctacgcggtggccaccaccatcatcaccccgatgatgcgccacacgatcgagaacaccaccgccaacatcagcctgaccgccatcgccaaccaggcggccatcctgatgggcctcgacaagggctggcccatctccaagatggacatcggggtccccctgctggccctcggctgctacagccaggtgaaccccctgacgctgaccgccgcggtgctcatgctggtcgcccactacgccatcatcgggccgggcctgcaggccaaggccacccgcgaggcgcagaagcggaccgccgccgggatcatgaagaaccccacggtggacggcatcgtggccatcgacctcgaccccgtcgtgtacgacgccaagttcgagaagcagctgggccagatcatgctgctcatcctgtgcacctcccagatcctgctcatgcgcaccacctgggcgctgtgcgagagcatcacgctggccaccgggcccctcaccaccctgtgggagggctccccggggaagttctggaacacgaccatcgccgtgagcatggccaacatcttccggggctcctacctggccggcgcggggctcgccttcagcctgatgaagtccctgggcgggggccgccgggggaccggcgcccagggcgagaccctcggggagaagtggaagcgccagctgaaccagctgtccaagagcgagttcaacacgtacaagcggtccggcatcatggaggtcgaccgcagcgaggccaaggaggggctcaagcggggcgagaccaccaagcacgcggtgtcccgcgggaccgccaagctgcggtggttcgtggagcgcaacctggtcaagcccgagggcaaggtgatcgacctgggctgcgggcggggcgggtggagctactactgcgccggcctcaagaaggtgacggaggtcaaggggtacaccaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgacgatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgccgtgaacatgacgtcccgcatgctcctgaaccgcttcaccatggcgcaccggaagcccacctacgagcgcgacgtggacctgggcgccggcacccggcacgtcgccgtggagcccgaggtggccaacctcgacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctctggggcttcctgtcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaacatccccggcggcaacatgtacgccgacgacaccgccgggtgggacacccggatcacggaggacgacctccagaacgaggcccgcatcaccgacatcatggagccggagcacgccctgctggcgaagtccatcttcaagctcacctaccagaacaaggtggtccgcgtgcagcggcccgccaagaacggcaccgtgatggacgtcatcagccgccgggaccagcgcgggtccggccaggtgggcacgtacgggctgaacaccttcaccaacatggaggcccagctgatccggcagatggagagcgagggcatcttctcccccagcgagctcgagacccccaacctggccgagcgcgtgctggactggctcgagaagtacggggtcgagcggctgaagcgcatggccatctccggcgacgactgcgtggtgaagccgatcgacgaccggttcgcgacggccctgaccgccctcaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctggtggggcgggcccgcgtgagccagggcgccgggtggagcctccgggagaccgcgtgcctgggcaagtcctacgcccagatgtggcagctgatgtacttccaccgccgggacctccgcctggccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcggcaagcgcgaggaccagtggtgcggcagcctgatcgggctgaccgcccgggccacctgggcgaccaacatccaggtggccatcaaccaggtccgccggctcatcggcaacgagaactacctggactacatgacctccatgaagcgcttcaagaacgagagcgaccccgagggggccctgtggtga

SEQ ID NO: 8783 - RNA, 9879 nt, synthetic construct
  misc_feature 1..9879: note = derived and/or modified CDS sequence (opt1) from DENV-1__EU482517__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaacaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgcggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctccggaagaacgggaagcgcgtgatccagctgtcccggaagacgttcgacaccgagtaccagaagaccaagaacaacgactgggactacgtcgtgaccacggacatcagcgagatgggcgcgaacttccgcgccgaccgggtgatcgacccgcgccggtgcctgaagcccgtcatcctcaaggacgggcccgagcgcgtgatcctggccggccccatgccggtgaccgtcgcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagacgttcgtggagctgatgcgccgcggggacctgcccgtctggctctcctacaaggtggccagcgagggcttccagtacagcgaccgccggtggtgcttcgacggcgagcgcaacaaccaggtgctggaggagaacatggacgtcgagatctggaccaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtgatgctccacaacagcgagcagggcgggcgggcgtaccgccacgccatggaggagctgcccgacacgatcgagaccctgatgctcctggccctgatcgccgtcctcaccggcggggtgaccctgttcttcctgtccggccgggggctcggcaagaccagcatcggcctgctgtgcgtgatggcctccagcgtcctcctgtggatggcgtccgtggagccccactggatcgccgccagcatcatcctggagttcttcctcatggtgctgctgatccccgagccggaccgccagcggacgccccaggacaaccagctcgcctacgtcgtgatcgggctgctgttcatgatcctcaccgtggccgcgaacgagatgggcctgctggagaccaccaagaaggacctcgggatcggccacgtcgccgtggagaaccaccaccacgccgccatgctggacgtggacctgcaccccgcctccgcgtggacgctctacgccgtcgccaccaccatcatcaccccgatgatgcgccacacgatcgagaacaccaccgccaacatcagcctgaccgccatcgcgaaccaggccgccatcctgatggggctcgacaagggctggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgcgaggcccagaagcggaccgccgccggcatcatgaagaaccccacggtggacgggatcgtcgccatcgacctcgaccccgtggtgtacgacgcgaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgccgtcagcatggccaacatcttccgggggtcctacctggcgggcgccggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggcgaaggagggcctcaagcgcggggagaccaccaagcacgccgtgtcccgcggcaccgccaagctgcggtggttcgtcgagcgcaacctggtgaagcccgaggggaaggtgatcgacctgggctgcggccgcgggggctggagctactactgcgccgggctcaagaaggtcacggaggtgaagggctacaccaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgacgatcgaggagggccgcaccctgcgggtgctcaagatggtggagccctggctgcgcgggaaccagttctgcatcaagatcctgaacccctacatgcccagcgtcgtggagaccctcgagcagatgcagcggaagcacggcggcatgctggtgcgcaacccgctgtcccggaacagcacccacgagatgtactgggtctcctgcgggaccggcaacatcgtgagcgcggtgaacatgacgtcccgcatgctcctgaaccgcttcaccatggcccaccggaagcccacctacgagcgcgacgtcgacctgggggccggcacccggcacgtggccgtggagcccgaggtcgccaacctcgacatcatcggccagcgcatcgagaacatcaagcacgagcacaagagcacgtggcactacgacgaggacaacccctacaagacctgggcgtaccacgggtcctacgaggtgaagccgagcggctccgccagcagcatggtgaacggggtcgtgaagctgctgaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgcgaagtggctctggggcttcctgtcccgcaacaagaagccccggatctgcacccgcgaggagttcacgcggaaggtgcgcagcaacgccgccatcggcgccgtcttcgtggacgagaaccagtggaactccgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcgcgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgcgctgctggccaagtccatcttcaagctcacctaccagaacaaggtcgtgcgcgtgcagcggcccgccaagaacgggaccgtcatggacgtgatcagccgccgggaccagcgcggctccggccaggtggggacgtacggcctgaacaccttcaccaacatggaggcccagctgatccggcagatggacagcgaggggatcttctcccccagcgagctcgagacccccaacctggccgagcgcgtcctggactggctcgagaagtacggcgtggagcggctgaagcgcatggcgatctccggggacgactgcgtggtcaagccgatcgacgaccggttcgccacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctggtgggccgggcccgcgtcagccagggggcgggctggagcctccgggagaccgcctgcctggggaagtcctacgcccagatgtggcagctgatgtacttccaccgccgggacctccgcctggccgcgaacgccatctgcagcgccgtgcccgtggactggatccccacctcccggacgacctggagcatccacgcccaccaccagtggatgaccaccgaggacatgctgtccgtctggaaccgcgtgtggatcgaggagaacccctggatggaggacaagacgcacatcagctcctggggcgacgtgccgtacctcgggaagcgcgaggaccagtggtgcggcagcctgatcggcctgaccgcccgggcgacctgggccaccaacatccaggtcgccatcaaccaggtgcgccggctcatcgggaacgagaactacctggactacatgacctccatgaagcgcttcaagaacgagagcgaccccgagggcgccctgtggtga

SEQ ID NO: 8784 - RNA, 9879 nt, synthetic construct
  misc_feature 1..9879: note = derived and/or modified CDS sequence (opt1) from DENV-1__EU482519__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggggagctgtgcgaggacaccatgacctacaagtgcccccggatcaccgaggccgagcccgacgacgtggactgctggtgcaacgccaccgacacctgggtgacctacgggacctgcagccagacgggggagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatggccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaaggtggtccagtacgagaacctgaagtactccgtgatcgtgaccgtccacacgggcgaccagcaccaggtggggaacgagagcaccgagcacggcaccaccgcgaccatcacgccccaggcccccacctccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgatccagaacggccggctgatcacggccaacccgatcgtgaccgacaaggagaagcccgtcaacatcgaggccgagccgcccttcggggagtcctacatcgtgatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtcttcacgagcgtggggaagctggtgcaccagatcttcggcaccgcctacggggtcctcttctccggcgtgagctggaccatgaagatcgggatcggcgtgctgctgacctggctcggcctgaactcccgcagcacgtccctgagcatgacctgcatcgccgtcgggctcgtgaccctgtacctgggcgtgatggtccaggccgactccgggtgcgtgatcaactggaagggccgggagctcaagtgcgggagcggcatcttcgtgaccaacgaggtccacacgtggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcccaggggaagaagatgatccggccccagcccatggagcacaagtacagctggaagtcctggggcaaggcgaagatcatcggcgccgacgtgcagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtccacgccgacatgggctactggatcgagtccgagaagaacgagacctggaagctggcccgggcgagcttcatcgaggtgaagacctgcatctggcccaagtcccacaccctgtggagcaacggcgtgctcgagtccgagatggtcatccccaagatctacgggggcccgatcagccagcacaactaccgccccgggtacttcacgcagaccgccggcccctggcacctggggaagctggagctcgacttcgacctgtgcgagggcaccaccgtggtggtcgacgagcactgcggcaaccgggggccgtccctgcgcacgaccaccgtgaccggcaagatcatccacgagtggtgctgccggagctgcacgctgccgcccctccgcttcaagggggaggacggctgctggtacgggatggagatccggcccgtgaaggagaaggaggagaacctggtcaagtccatggtgagcgccggcagcggcgaggtggactccttcagcctcgggctgctgtgcatctccatcatgatcgaggaggtcatgcgcagccggtggtcccgcaagatgctcatgaccggcaccctggccgtgttcctgctcctgatcatggggcagctgacctggaacgacctcacgcggctgtgcatcatggtgggcgccaacgcgagcgaccgcatggggatgggcaccacctacctggccctcatggccaccttcaagatgcgcccgatgttcgccgtcggcctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtgctgagcatcgtctccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtgggcgtcgtgagcatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgaccctgctggccgtgtccggcgtgtacccgctcagcatccccgccacgctgttcgtctggtacttctggcagaagaagaagcagcgctccggggtgctgtgggacacccccagcccgcccgaggtggagcgggccgtcctggacgacggcatctaccgcatcatgcagcggggcctcctggggcgctcccaggtgggcgtgggggtcttccaggagaacgtgttccacaccatgtggcacgtgacccggggcgccgtcctgatgtaccaggggaagcgcctcgagcccagctgggcgtccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgccatcgccctcgacttcaagcccgggacgagcggctcccccatcgtgaaccgcgaggggaagatcgtgggcctgtacggcaacggggtcgtgaccaccagcggcacctacgtgagcgcgatcgcccaggccaaggcctcccaggaggggccgctgcccgagatcgaggacgaggtcttccggaagcgcaacctcacgatcatggacctgcaccccggcagcgggaagacccggcgctacctgccggcgatcgtgcgggaggccatcaagcgcaagctccggaccctgatcctggcccccacccgcgtggtcgcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcccacttcaccgaccccagctccatcgccgcgcgggggtacatcagcacccgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccgcgccggtgcctcaagcccgtcatcctgaaggacgggcccgagcgcgtgatcctggccggccccatgccggtgacggtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtgtggctgtcctacaaggtcgccagcgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgccgcgggccgccggagcgtctccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagccggaccgccagcggacgccccaggacaaccagctggcctacgtggtcatcgggctcctgttcatgatcctgacggtggccgccaacgagatgggcctgctcgagaccaccaagaaggacctggggatcggccacgtggcggtcgagaaccaccaccacgccaccatgctggacgtggacctccaccccgcctccgcctggacgctgtacgccgtggcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtccccctgctcgccctggggtgctacagccaggtgaaccccctgacgctcaccgccgccgtgctgatgctggtcgcgcactacgccatcatcggcccggggctccaggccaaggccacccgggaggcccagaagcgcaccgcggccggcatcatgaagaaccccacggtggacgggatcgtggccatcgacctggaccccgtcgtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtcgaccgcagcgaggccaaggagggcctgaagcgcggggagacgacccgccacgccgtgtcccggggcaccgcgaagctgcgctggttcgtggagcggaacctggtcaagcccgaggggaaggtgatcgacctcggctgcggccgcgggggctggagctactactgcgccgggctgaagaaggtgaccgaggtcaagggctacacgaagggcgggcccggccacgaggagcccatcccgatggccacctacgggtggaacctggtgaagctccactccggcaaggacgtgttcttcacgccgcccgagaagtgcgacaccctgctgtgcgacatcggggagagctcccccaacccgacgatcgaggagggccggaccctccgcgtcctgaagatggtggagccctggctgcgggggaaccagttctgcatcaagatcctcaacccctacatgcccagcgtggtcgagaccctggagcagatgcagcgcaagcacggcggcatgctggtgcggaacccgctctcccgcaacagcacccacgagatgtactgggtgtcctgcgggaccggcaacatcgtcagcgccgtgaacatgacgtcccggatgctgctgaaccgcttcaccatggcccaccgcaagcccacctacgagcgggacgtggacctcggggcgggcacccgccacgtcgccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgccagcagcatggtgaacggggtcgtgaagctgctcaccaagccctgggacgtgatccccatggtcacccagatcgcgatgacggacaccacccccttcggccagcagcgcgtgttcaaggagaaggtggacacccggacgccgaaggccaagcgcgggaccgcccagatcatggaggtcaccgcccggtggctgtggggcttcctgtcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctcgtgcagaaggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtggtccgggtgcagcgccccgcgaagaacgggacggtgatggacgtcatcagccgccgggaccagcgcggctccggccaggtgggcacctacggcctgaacaccttcaccaacatggaggcccagctcatccggcagatggagagcgaggggatcttcctgccctccgagctggagacgcccaacctcgccgagcgcgtgctggactggctggagaagcacggcgtcgagcggctcaagcgcatggccatcagcggggacgactgcgtggtgaagccgatcgacgaccggttcgccaccgcgctgaccgccctgaacgacatgggcaaggtccgcaaggacatcccccagtgggagccctccaaggggtggaacgactggcagcaggtccccttctgcagccaccacttccaccagctcatcatgaaggacggccgggagatcgtggtcccgtgccgcaaccaggacgagctggtgggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtccccgtggactgggtgcccacgagccggaccacctggtccatccacgcccaccaccagtggatgaccacggaggacatgctgagcgtctggaaccgcgtgtggatcgaggagaacccctggatggaggacaagacccacgtgtccagctggggcgacgtcccgtacctggggaagcgggaggaccagtggtgcggctccctcatcggcctgaccgcccgcgccacctgggccagcaacatccaggtggcgatcaaccaggtgcgccggctgatcgggaacgagaactacctcgactacatgacctccatgaagcgcttcaagaacgagggcgaccccgagggggccctgtggtga

SEQ ID NO: 8785 - RNA, 9879 nt, synthetic construct
  misc_feature 1..9879: note = derived and/or modified CDS sequence (opt1) from DENV-1__EU482520__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgcgggagaagtcctggctcgtgcacaagcagtggttcctggacctgcccctcccctggaccagcggggccagcacgtcccaggagacctggaaccgccaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccggctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccgcctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccgccgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccggagcacctccctgagcatgacctgcatcgccgtggggctcgtcacgctgtacctgggcgtgatggtgcaggccgactccgggtgcgtcatcaactggaagggccgcgagctcaagtgcgggagcggcatcttcgtgaccaacgaggtgcacacctggaccgagcagtacaagttccaggccgacagcccgaagcggctgtccgcggccatcggcaaggcctgggaggagggggtctgcggcatccgcagcgccacccggctggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtacagctggaagtcctggggcaaggccaagatcatcggcgccgacgtgcagaacaccaccttcatcatcgacgggcccaacaccccggagtgccccgacgaccagcgggcctggaacatctgggaggtcgaggactacggcttcgggatcttcacgaccaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacgtgcatctggcccaagtcccacaccctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcacgaccgtggtcgtggacggccactgcgggaaccgcggcccgtccctgcggaccaccacggtgaccgggaagatcatccacgagtggtgctgccgcagctgcaccctgccgcccctccggttccgcggcgaggacgggtgctggtacggcatggagatccggcccgtcaaggagaaggaggagaacctggtgaagtccatggtgagcgccggcagcggggaggtcgactccttcagcctcggcctgctgtgcatctccatcatgatcgaggaggtgatgcgcagccggtggtcccgcaagatgctcatgaccgggatcctggccgtgttcttcctgctcatcatgggccagctgacgtggaacgacctgatccgcctctgcatcatggtcggggccaacgcgagcgaccggatgggcatgggcaccacctacctggccctgatggccaccttcaagatgcgcccgatgttcgccgtggggctcctgttccggcgcctgacgtcccgggaggtgctcctgctgaccatcggcctcagcctggtcgcctccgtggagctgcccaacagcctcgaggagctgggggacggcctggcgatgggcatcatgatcctcaagctgctgaccgacttccagtcccaccagctctgggccaccctgctgagcctcacgttcatcaagaccaccttctccctgcactacgcctggaagaccatggccatggtcctgagcatcgtgtccctcttccccctgtgcctgagcacgacctcccagaagaccacctggctccccgtgctgctggggagcctcggctgcaagccgctgacgatgttcctgatcgcggagaacaagatctgggggcgccggtcctggcccctcaacgagggcatcatggccgtcgggatcgtgagcatcctgctgagctccctcctgaagaacgacgtgcccctggccggccccctcatcgccggcgggatgctgatcgcctgctacgtcatcagcggctccagcgcggacctgtccctcgagaaggccgccgaggtgagctgggaggaggaggccgagcactccggggccagccacaacatcctggtggaggtccaggacgacggcaccatgaagatcaaggacgaggagcgcgacgacaccctgaccatcctcctgaaggcgaccctgctcgccgtgtccggggtgtacccgctgagcatccccgccacgctgttcgtctggtacttctggcagaagaagaagcagcggtccggcgtgctctgggacacccccagcccgcccgaggtgggccgcgccgtcctggacgacgggatctaccggatcatgcagcgcggcctgctggggcggtcccaggtgggcgtgggggtcttccaggagaacgtgttccacaccatgtggcacgtgacccgcggcgccgtcctcatgtaccagggcaagcggctggagcccagctgggcgtccgtgaagaaggacctgatcagctacgggggcgggtggcgcctccagggctcctggaacacgggggaggaggtgcaggtcatcgccgtggagcccggcaagaaccccaagaacgtgcagaccgcccccggcaccttcaagacccccgagggggaggtcggcgccatcgccctggacttcaagcccgggacgagcggctcccccatcgtgaaccgggagggcaagatcgtggggctgtacggcaacggggtcgtgaccaccagcggcacctacgtgagcgcgatcgcccaggccaaggcctcccaggaggggccgctccccgagatcgaggacgaggtcttccgcaagcggaacctgacgatcatggacctgcaccccggcagcggcaagacccgccggtacctcccggcgatcgtgcgcgaggccatcaagcgcaagctgcggaccctgatcctcgcccccacccgcgtggtcgcctccgagatggccgaggcgctgaaggggatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgccgcgcgcgggtacatcagcacccgggtgggcatgggggaggccgccgccatcttcatgaccgccacgccgcccggctccgtcgaggcgttcccgcagagcaacgccgtgatccaggacgaggagcgcgacatccccgagcggtcctggaacagcggctacgagtggatcaccgacttccccgggaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgccaacttccgggcggaccgcgtgatcgacccgcggcgctgcctgaagcccgtgatcctgaaggacgggcccgagcgggtcatcctcgccggccccatgccggtgacggtcgcctccgccgcccagcgccggggccgcatcgggcgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagaccttcgtggagctcatgcggcgcggcgacctgcccgtgtggctgtcctacaaggtcgccagcgaggggttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgccgcgggccggcgcagcgtctccggcgacctgatcctcgagatcgggaagctgccgcagcacctgacccagcgggcccagaacgccctcgacaacctggtgatgctgcacaacagcgagcagggcgggcgcgcctaccggcacgcgatggaggagctccccgacaccatcgagacgctgatgctgctcgccctgatcgccgtgctgaccggcggggtcaccctcttcttcctgtccggccgcggcctggggaagaccagcatcggcctcctgtgcgtgatggcctccagcgtgctgctctggatggcctccgtcgagccccactggatcgcggccagcatcatcctggagttcttcctgatggtgctcctgatccccgagccggaccggcagcgcacgccccaggacaaccagctggcctacgtggtcatcgggctcctgttcatgatcctgacggtggccgccaacgagatgggcctcctggagaccaccaagaaggacctggggatcggccacgtggcggtcgagaaccaccaccacgccgccatgctcgacgtggacctgcaccccgcctccgcctggaccctgtacgcggtggccacgaccatcatcaccccgatgatgcgccacaccatcgagaacacgaccgccaacatcagcctcaccgccatcgccaaccaggcggccatcctgatgggcctggacaaggggtggcccatctccaagatggacatcggcgtccccctcctggccctggggtgctacagccaggtgaaccccctcaccctgacggccgcggtgctgatgctcgtcgcccactacgccatcatcggcccggggctgcaggccaaggccacccgggaggcgcagaagcgcaccgccgccggcatcatgaagaaccccaccgtggacggcatcgtggccatcgacctggaccccgtcgtgtacgacgccaagttcgagaagcagctcgggcagatcatgctgctgatcctctgcacgtcccagatcctgctgatgcggaccacctgggcgctctgcgagagcatcaccctggccacgggccccctgaccaccctctgggaggggtccccgggcaagttctggaacaccacgatcgccgtgagcatggccaacatcttccgcggctcctacctggccggggcgggcctggccttcagcctcatgaagtccctcgggggcgggcggcgcggcaccggcgcccagggggagaccctgggcgagaagtggaagcggcagctcaaccagctgtccaagagcgagttcaacacctacaagcgctccgggatcatggaggtcgaccggagcgaggccaaggagggcctgaagcgcggggagacgaccaagcacgcggtgtcccggggcaccgccaagctccgctggttcgtggagcggaacctggtcaagcccgagggcaaggtgatcgacctggggtgcggccgcgggggctggagctactactgcgccgggctgaagaaggtgaccgaggtcaagggctacacgaagggcgggcccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccggggcaaccagttctgcatcaagatcctgaacccctacatgcccagcgtggtcgagaccctggagcagatgcagcgcaagcacgggggcatgctcgtgcggaacccgctgtcccgcaacagcacccacgagatgtactgggtgtcctgcgggaccggcaacatcgtcagcgccgtgaacatgacctcccgcatgctgctcaaccggttcacgatggcgcaccgcaagcccacctacgagcgggacgtggacctgggcgccgggacccgccacgtcgccgtggagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgcgagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcggcacggcccagatcatggaggtcaccgccaagtggctgtgggggttcctctcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctgcacaagcaggggaagtgcgccacgtgcgtctacaacatgatgggcaagcgggagaagaagctcggggagttcggcaaggccaagggcagccgcgccatctggtacatgtggctgggggcccggttcctggagttcgaggcgctcggcttcatgaacgaggaccactggttctcccgcgagaacagcctgtccggggtggagggcgaggggctgcacaagctcggctacatcctgcgggacatcagcaacatccccggcgggaacatgtacgccgacgacaccgccggctgggacacccgcatcaccgaggacgacctgcagaacgaggcccgcatcacggacatcatggagccggagcacgccctcctggcgaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggccatctccggggacgactgcgtggtgaagccgatcgacgaccgcttcgcgaccgccctgacggccctgaacgacatgggcaaggtccggaaggacatcccccagtgggagcccagcaagggctggaacgactggcagcaggtccccttctgctcccaccacttccaccagctcatcatgaaggacgggcgcgagatcgtggtcccgtgccggaaccaggacgagctggtgggccgcgcccgggtgagccagggggccggctggagcctgcgcgagaccgcgtgcctcgggaagtcctacgcccagatgtggcagctgatgtacttccaccggcgcgacctgcggctcgccgccaacgcgatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctgggcaagcgggaggaccagtggtgcgggagcctcatcggcctgacggcccgcgccacctgggcgaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8786 - RNA, 9879 nt, synthetic construct
  misc_feature 1..9879: note = derived and/or modified CDS sequence (opt1) from DENV-1__EU482521__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggccgcatgttcgaggccaccgcccgcggggcccgccgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccggagcacctccttcagcatgacctgcatcgccgtggggctggtgaccctctacctgggcgtcatggtgcaggccgactccgggtgcgtgatcaactggaagggccgcgagctgaagtgcgggagcggcatcttcgtcacgaacgaggtgcacacctggaccgagcagtacaagttccaggcggacagcccgaagcggctctccgccgccatcggcaaggcctgggaggagggggtgtgcggcatccgcagcgccacccggctggagaacatcatgtggaagcagatctccaacgagctgaaccacatcctcctggagaacgacatgaagttcaccgtcgtggtgggggacgtcgcgggcatcctggcccaggggaagaagatgatccgcccccagcccatggagtacaagtacagctggcggtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctcaagctgcgggacagctacacccaggtctgcgaccaccgcctgatgtccgccgccatcaaggacagcaaggccgtgcacgccgacatgggctactggatcgagtccgagaagaacgagacctggaagctcgcgcgggccagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccgcaagatgctgatgaccggcaccctcgccgtgttcctgctgctcatcatggggcagctgacgtggaacgacctgatccggctctgcatcatggtgggcgcgaacgccagcgaccgcatggggatgggcaccacctacctggccctgatggccaccttcaagatgcggccgatgttcgccgtcgggctcctgttccgccggctgacgtcccgcgaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgggacgacaccctgaccatcctcctgaaggccaccctgctcgccgtctccggcgtgtacccgctgagcatccccgccacgctgttcgtgtggtacatctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacccggggcgcggtgctcatgtaccaggggaagcgcctggagcccagctgggcctccgtcaagaaggacctgatcagctacggcggcgggtggcggctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctccccgagatcgaggacgaggtgttccggaagcgcaacctgacgatcatggacctgcaccccggcagcgggaagacccggcgctacctcccggccatcgtccgcgaggccatcaagcggaagctgcgcaccctgatcctcgcccccacccgggtggtggcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctctcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctgaaggacgggcccgagcgcgtgatcctcgccggccccatgccggtcacggtggcctccgccgcgcagcggcgcgggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtcgagctcatgcgccgcggggacctgcccgtgtggctgtcctacaaggtggccagcgagggcttccagtacagcgaccgccggtggtgcttcgacggcgagcgcaacaaccaggtcctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtgtccggggacctgatcctcgagatcggcaagctgccgcagcacctgacccagcgcgcccagaacgccctcgacaacctggtcatgctgcacaacagcgagcagggcgggcgggcgtaccgccacgccatggaggagctccccgacaccatcgagacgctgatgctgctcgccctgatcgccgtgctgaccggcggggtgaccctcttcttcctgtccggccgggggctgggcaagaccagcatcggcctcctgtgcgtcatggcctccagcgtgctgctctggatggcgtccgtggagccccactggatcgccgccagcatcatcctggagttcttcctgatggtcctcctgatccccgagccggaccgccagcgcacgccccaggacaaccagctggcctacgtggtgatcgggctcctgttcatgatcctgacggtcgccgcgaacgagatgggcctcctggagaccaccaagaaggacctggggatcggccacgtggccgtggggaaccaccaccacgccgccatgctcgacgtcgacctgcaccccgcctccgcgtggaccctgtacgccgtggccacgaccatcatcaccccgatgatgcggcacaccatcgagaacacgaccgccaacatcagcctcaccgccatcgcgaaccaggccgccatcctgatgggcctggacaagggctggcccatctccaagatggacatcggggtgcccctcctggccctgggctgctacagccaggtcaaccccctcaccctgacggcggccgtgctgatgctcgtggcccactacgccatcatcgggccgggcctgcaggccaaggcgacccgcgaggcccagaagcggaccgccgccgggatcatgaagaaccccaccgtcgacggcatcgtggccatcgacctggaccccgtggtctacgacgcgaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcatggaggtggaccgcagcgaggcgaaggaggggctgaagcggggcgagatcacgaagcacgccgtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagcccatcccgatggccacgtacggctggaacctcgtcaagctgcactccgggaaggacgtgttcttcgtgccgcccgagaagtgcgacaccctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagacgctggagcagatgcagcggaagcacggcgggatgctcgtgcgcaacccgctgtcccgcaacagcacccacgagatgtactgggtgtcctgcggcaccgggaacatcgtcagcgcggtgaacatgacctcccggatgctgctcaaccgcttcaccatggcccaccggaagcccacgtacgagcgcgacgtggacctgggcgccggcacccggcacgtcgccgtggagcccgaggtggccaacctggacatcatcgggcagcgcatcgagaacatcaagcacgagcacaagagcacctggcactacgacgaggacaacccctacaagacctgggcgtaccacggctcctacgaggtcaagccgagcgggtccgccagcagcatggtgaacggcgtcgtgaagctcctgacgaagccctgggacgtgatccccatggtcacccagatcgccatgaccgacaccacgcccttcgggcagcagcgggtgttcaaggagaaggtggacacccgcaccccgaaggccaagcggggcaccgcccagatcatggaggtcacggcgaagtggctgtggggcttcctctcccgcaacaagaagccccggatctgcacccgcgaggagttcacccggaaggtgcgcagcaacgccgccatcggggccgtgttcgtcgacgagaaccagtggaactccgcgaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcgcgcttcctggagttcgaggccctcgggttcatgaacgaggaccactggttctcccgggagaacagcctgtccggcgtggagggggagggcctgcacaagctcgggtacatcctgcgcgacatcagcaagatccccggcggcaacatgtacgccgacgacacggccgggtgggacacccgcatcaccgaggacgacctgcagaacgaggcccggatcaccgacatcatggagccggagcacgcgctcctggccaagtccatcttcaagctgacgtaccagaacaaggtggtccgcgtgcagcggcccgccaagaacggcaccgtgatggacgtcatcagccgccgggaccagcgcgggtccggccaggtgggcacctacgggctcaacaccttcacgaacatggaggcccagctgatccggcagatggagagcgagggcatcttctcccccagcgagctggagacccccaacctcgccgagcgcgtgctggactggctggagaagtacggggtcgagcggctcaagcgcatggcgatctccggcgacgactgcgtggtgaagccgatcgacgaccggttcgccaccgccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgcggggtggagcctgcgggagacggcctgcctcggcaagtcctacgcccagatgtggcagctgatgtacttccaccgccgggacctgcgcctcgccgcgaacgccatctgcagcgccgtccccgtggactggatccccacctcccgcaccacctggagcatccacgcccaccaccagtggatgacgaccgaggacatgctgtccgtgtggaaccgggtctggatcgaggagaacccctggatggaggacaagacccacatcagctcctggggcgacgtgccgtacctgggcaagcgcgaggaccagtggtgcggcagcctcatcgggctgaccgcccgggcgacgtgggccaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8787 - RNA, 9879 nt, synthetic construct
  misc_feature 1..9879: note = derived and/or modified CDS sequence (opt1) from DENV-1__EU482523__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccaggccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggcgcatgctcatgaccggcaccctggccgtgttcttcctgctcatcatggggcagctgacgtggaacgacctgatccgcctctgcatcatggtcggcgcgaacgccagcgaccggatggggatgggcaccacctacctggccctgatggccaccttcaagatgcgcccgatgttcgccgtgggcctcctgttccggcgcctgacgtcccgggaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcgcaagctgcggaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcggaccacctgggccctctgcgagagcatcaccctggccacgggccccctgaccaccctctgggaggggtccccgggcaagttctggaacaccacgatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtcgaccggagcgaggcgaaggagggcctgaagcgcggggagacgaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccggacgctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgcggtgaacatgacctcccgcatgctgctcaaccggttcacgatggcccaccgcaagcccacctacgagcgggacgtggacctgggggccggcacccgccacgtcgccgtggagcccgaggtggccaacctggacatcatcggccagcggatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgcgtgttcaaggagaaggtggacacccggaccccgaaggccaagcgcgggacggcccagatcatggaggtcaccgcgaagtggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacccgcatcaccgaggacgacctgcagaacgaggcccgcatcacggacatcatggagccggagcacgcgctcctggccaagtccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8788 - RNA, 9879 nt, synthetic construct
  misc_feature 1..9879: note = derived and/or modified CDS sequence (opt1) from DENV-1__EU482525__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccttcagcatgacctgcatcgccgtggggctggtcaccctctacctgggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctctccgccgccatcggcaaggcctgggaggagggggtctgcggcatccggagcgccacccgcctggagaacatcatgtggaagcagatctccaacgagctgaaccacatcctcctggagaacgacatgaagctgaccgtggtggtcggggacgtggcgggcatcctcgggcagggcaagaagatgatccggccccagcccatggagtacaagtacagctggaagtcctggggcaaggccaagatcatcggggccgacgcccagaacacgaccttcatcatcgacggccccaacaccccggagtgccccgacgaccagcgcgcgtggaacatctgggaggtggaggactacgggttcggcatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtggtcgacgagcactgcgggaaccggggcccgtccctgcgcaccaccaccgtgacggggaagatcatccacgagtggtgctgccggagctgcaccctgccgcccctccgcttccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggaccctggccgtgttcttcctgctcatcatgggccagctgacgtggaacgacctgatccgcctctgcatcatggtgggggcgaacgccagcgaccgcatgggcatgggcaccacctacctggccctgatggccaccttcaagatgcggccgatgttcgccgtcgggctcctgttccgccggctgacgtcccgcgaggtgctcctgctgaccatcggcctcagcctggtggcgtccgtcgagctgcccaacagcctcgaggagctgggggacggcctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctggggagcctcggctgcaagccgctgacgatgttcctgatcgccgagaacaagatctgggggcggaagtcctggcccctcaacgagggcatcatggccgtggggatcgtcagcatcctgctgagctccctcctgaagaacgacgtgcccctggccggccccctcatcgccggcgggatgctgatcgcgtgctacgtgatcagcggctccagcgccgacctgtccctcgagaaggccgccgaggtcagctgggaggaggaggccgagcactccggggcgagccacaacatcctggtggaggtgcaggacgacggcaccatgaagatcaaggacgaggagcgcgacgacaccctgaccatcctcctgaaggccaccctgctcgccgtctccggggtgtacccgctgagcatccccgccacgctgttcgtgtggtacttctggcagaagaagaagcagcggtccggcgtcctctgggacacccccagcccgcccgaggtggagcgcgccgtgctggacgacggcatctaccggatcatgcagcgcgggctgctgggccggtcccaggtcggggtgggcgtgttccaggagaacgtcttccacaccatgtggcacgtgacccgcggggcggtgctcatgtaccagggcaagcggctggagcccagctgggcctccgtcaagaaggacctgatcagctacggcgggggctggcgcctccgggggtcctggaacacgggcgaggaggtccaggtgatcgccgtcgagcccgggaagaaccccaagaacgtgcagaccgcccccggcaccttcaagacccccgagggcgaggtgggggccatcgcgctggacttcaagcccggcacgagcgggtcccccatcgtcaaccgcgagggcaagatcgtgggcctgtacgggaacggcgtggtcaccaccagcgggacctacgtgagcgccatcgcccaggccaaggcgtcccaggagggcccgctccccgagatcgaggacgaggtgttccggaagcgcaacctgacgatcatggacctgcaccccgggagcggcaagacccggcgctacctcccggccatcgtccgggaggccatcaagcgcaagctgcgcaccctgatcctcgcccccacccgggtggtggcctccgagatggcggaggccctgaagggcatgcccatccgctaccagacgaccgccgtcaagagcgagcacaccgggaaggagatcgtggacctgatgtgccacgccaccttcacgatgcggctcctgtcccccgtgcgcgtcccgaactacaacatgatcatcatggacgaggcccacttcaccgaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcaccgacttccccggcaagaccgtgtggttcgtgccctccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggcgaacttccgcgccgaccgggtcatcgacccgcgccggtgcctgaagcccgtgatcctgaaggacggccccgagcgcgtgatcctcgccgggcccatgccggtcacggtggcctccgccgcgcagcggcgcggccggatcggccgcaaccacaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcggtcgacggcgagtaccggctgcgcggggaggcccggaagaccttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggacgaaggagggcgagcggaagaagctgcgcccccggtggctggacgcccgcacctactccgaccccctcgccctgcgggagttcaaggagttcgcggccgggcgccggagcgtctccggcgacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatgggcctggacaagggctggcccatctccaagatggacatcggggtccccctcctggccctgggctgctacagccaggtgaaccccctcaccctgacggcggccgtgctgatgctcgtcgcccactacgccatcatcgggccgggcctgcaggccaaggcgacccgcgaggcccagaagcggaccgccgccgggatcatgaagaaccccaccgtggacggcatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacggggcccctgaccaccctctgggagggctccccggggaagttctggaacaccacgatcgccgtgagcatggccaacatcttccggggctcctacctggcgggcgccgggctggccttcagcctcatgaagtccctgggcgggggccgccgggggaccggcgcccagggcgagaccctgggggagaagtggaagcgccagctcaaccagctgtccaagagcgagttcaacacctacaagcggtccggcatcatggaggtcgaccgcagcgaggcgaaggaggggctgaagcggggcgagacgaccaagcacgccgtgtcccgcgggaccgccaagctccggtggttcgtggagcgcaacctggtcaagcccgagggcaaggtgatcgacctgggctgcgggcggggcgggtggagctactactgcgccggcctgaagaaggtgaccgaggtcaaggggtacacgaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgaccatcgaggaggggcgcacgctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgcggtgaacatgacctcccgcatgctgctcaaccgcttcacgatggcccaccggaagcccacctacgagcgcgacgtggacctgggcaccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgcccgctggctgtggggcttcctctcccggaacaagaagccccgcatctgcacccgggaggagttcacgcgcaaggtgcggagcaacgcggccatcggggccgtgttcgtcgacgagaaccagtggaactccgccaaggaggcggtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtggagggggagggcctgcacaagctcgggtacatcctgcgggacatcagcaagatccccggcggcaacatgtacgccgacgacaccgccgggtgggacacccgcatcacggaggacgacctgcagaacgaggccaagatcaccgacatcatggagccggagcacgccctcctggcgaaggccatcttcaagctgacctaccagaacaaggtggtccgcgtgcagcggcccgccaagaacggcaccgtgatggacgtcatctcccgccgggaccagcgcgggagcggccaggtgggcacgtacgggctcaacaccttcaccaacatggaggcccagctgatccggcagatggagtccgagggcatcttcagcccctccgagctggagacccccaacctcgccgagcgcgcgctggactggctggagaagtacgggatcgagcggctcaagcgcatggccatcagcggcgacgactgcgtggtcaagccgatcgacgaccggttcgccacggccctgaccgccctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcgcgcgtctcccagggcgccgggtggagcctgcgggagaccgcctgcctcggcaagagctacgcccagatgtggcagctgatgtacttccaccgccgggacctgcgcctcgcggccaacgccatctgctccgccgtgcccgtggactgggtccccaccagccggacgacctggtccatccacgcccaccaccagtggatgaccaccgaggacatgctgagcgtgtggaaccgcgtgtggatcgaggagaacccctggatggaggacaagacgcacatctccagctgggaggacgtcccgtacctggggaagcgcgaggaccagtggtgcggctccctcatcggcctgaccgcgcgggccacctgggccaccaacatccaggtggccatcaaccaggtgcgccggctgatcgggaacgagaactacctcgactacatgaccagcatgaagcgcttcaagaacgagacggaccccgagggcgccctgtggtga

SEQ ID NO: 8789 - RNA, 9879 nt, synthetic construct
  misc_feature 1..9879: note = derived and/or modified CDS sequence (opt1) from DENV-1__EU482526__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctgttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgtgggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgcgagcgaccgcatggggatgggcaccacctacctggccctcatggccaccttcaagatgcgcccgatgttcgccgtggggctgctgttccggcgcctcacgtcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccctgtccctccactacgcctggaagaccatggccatggtcctgagcatcgtgtccctgttccccctctgcctgagcacgacctcccagaagaccacctggctgcccgtgctcctgggcagcctggggtgcaagccgctcacgatgttcctgatcgcggagaacaagatctggggccgcaagtcctggcccctgaacgaggggatcatggccgtcggcgtggtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgccgtgctgatgtaccaggggaagcgcctcgagcccagctgggcgtccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgccctcgacttcaagcccgggacgagcggctcccccatcgtgaaccgcgaggggaagatcgtcggcctgtacggcaacggggtggtgaccaccagcggcacctacgtcagcgcgatcgcccaggccaaggcctcccaggaggggccgctgcccgagatcgaggacgaggtgttccggaagcgcaacctcacgatcatggacctgcaccccggcagcgggaagacccggcgctacctgccggcgatcgtgcgggaggccatcaagcgcaagctccggaccctgatcctggcccccacccgcgtcgtggcctccgagatggccgaggcgctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgaccgccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgccaacttccgcgcggaccgggtgatcgacccgcgccggtgcctcaagcccgtcatcctgaaggacgggcccgagcgcgtgatcctggccggccccatgccggtcacggtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgggagaagtccgccgccatcgacggggagtaccgcctgcgcggcgaggcgcggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgacggtggccgccaacgagatgggcctgctcgagaccaccaagaaggacctggggatcggccacgtcgcggtggagaaccaccaccacgccaccatgctggacgtggacctccaccccgcctccgcctggacgctgtacgccgtcgcgaccaccatcatcaccccgatgatgcgccacacgatcgagaacaccaccgccaacatcagcctgaccgccatcgccaaccaggccgcgatcctcatggggctggacaagggctggcccatctccaagatggacatcggcgtgcccctgctcgccctggggtgctacagccaggtgaaccccctgacgctcaccgccgccgtcctgatgctggtggcgcactacgccatcatcggcccggggctccaggccaaggccacccgggaggcccagaagcgcaccgcggccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggccctgtgcgagagcatcacgctcgcgaccggccccctgaccaccctgtgggaggggtccccgggcaagttctggaacacgaccatcgccgtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagacgacccgccacgccgtgtcccggggcaccgcgaagctgcgctggttcgtcgagcggaacctggtgaagcccgaggggaaggtgatcgacctcggctgcggccgcgggggctggagctactactgcgccgggctgaagaaggtcaccgaggtgaagggctacacgaagggcgggcccggccacgaggagcccatcccgatggccacctacgggtggaacctggtgaagctccactccggcaaggacgtcttcttcacgccgcccgagaagtgcgacaccctgctgtgcgacatcggggagagctcccccaacccgacgatcgaggagggccggaccctccgcgtgctgaagatggtggagccctggctgcgggggaaccagttctgcatcaagatcctcaacccctacatgcccagcgtcgtggagaccctggagcagatgcagcgcaagcacggcggcatgctggtgcggaacccgctctcccgcaacagcacccacgagatgtactgggtctcctgcgggaccggcaacatcgtgagcgccgtgaacatgacgtcccggatgctgctgaaccgcttcaccatggcccaccgcaagcccacctacgagcgggacgtcgacctcggggcgggcacccgccacgtggccgtggagcccgaggtcgccaacctggacatcatcggccagcggatcgagaacatcaagcacgagcacaagagcacgtggcactacgacgaggacaacccctacaagacctgggcctaccacgggtcctacgaggtgaagccgagcggctccgccagcagcatggtcaacggggtggtgaagctgctcaccaagccctgggacgtcatccccatggtgacccagatcgcgatgacggacaccacccccttcggccagcagcgcgtgttcaaggagaaggtcgacacccggacgccgaaggccaagcgcgggaccgcccagatcatggaggtgaccgcccggtggctgtggggcttcctgtcccgcaacaagaagccccggatctgcacccgcgaggagttcacgcggaaggtgcgcagcaacgccgcgatcggcgccgtcttcgtggacgagaaccagtggaactccgccaaggaggccgtggaggacgagcggttctgggacctcgtccagaaggagcgcgagctgcacaagcaggggaagtgcgcgacctgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtggagggcgaggggctgcacaagctgggctacatcctccgggacatcagcaagatccccgggggcaacatgtacgcggacgacaccgccggctgggacacccgcatcacggaggacgacctgcagaacgaggccaagatcaccgacatcatggagccggagcacgccctgctcgccacctccatcttcaagctgacctaccagaacaaggtcgtgcgggtgcagcgccccgcgaagaacgggacggtcatggacgtgatcagccgccgggaccagcgcggctccggccaggtgggcacctacggcctgaacaccttcaccaacatggaggcccagctcatccggcagatggagagcgaggggatcttctcccccagcgagctggagatccccaacctggccgagcgcgtcctcgactggctggagaagtacggcgtggagcggctgaagcgcatggccatctccggggacgactgcgtggtcaagccgatcgacgaccggttcgccacggcgctcaccgccctgaacgacatgggcaaggtgcgcaaggacgtgccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcctgcctggggaagtcctacgcgcagatgtggcagctcatgtacttccaccgccgggacctgcgcctggccgccaacgccatctgcagcgcggtgcccgtcgactgggtgcccacctcccggacgacctggagcatccacgcccaccaccagtggatgaccaccgaggacatgctctccgtgtggaaccgcgtctggatcgaggagaacccctggatggaggacaagacgcacgtgagctcctggggcgacgtgccgtacctggggaagcgggaggaccagtggtgcggcagcctgatcggcctcaccgcccgcgccacctgggcctccaacatccaggtcgcgatcaaccaggtgcgccggctgatcgggaacgagaactacctggactacatgaccagcatgaagcgcttcaagaacgagggcgaccccgagggggccctctggtga

SEQ ID NO: 8790 - RNA, 9879 nt, synthetic construct
  misc_feature 1..9879: note = derived and/or modified CDS sequence (opt1) from DENV-1__EU482527__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagacctccgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgggaagggcgtgacccagaacgggcggctgatcacggccaacccgatcgtgaccgacaaggagaagcccgtcaacatcgaggccgagccgcccttcggcgagagctacatcgtgatcggcgcgggggagaaggccctgaagctgtcctggttcaagaagggcagctccatcgggaagatgttcgaggccaccgcccgcggcgcccggcgcatggcgatcctcggggacaccgcctgggacttcggcagcatcggcggggtgttcacgtccgtcggcaagctggtgcaccagatcttcgggaccgcctacggcgtgctgttcagcggggtctcctggaccatgaagatcggcatcggcgtgctcctgacctggctggggctcaacagccgctccacgagcctgtccatgacctgcatcgccgtgggcctggtcaccctctacctgggggtgatggtgcaggccgacagcggctgcgtcatcaactggaaggggcgggagctgaagtgcggcagcggcatcttcgtgaccaacgaggtgcacacgtggaccgagcagtacaagttccaggcggactccccgaagcgcctcagcgccgccatcgggaaggcctgggaggagggcgtctgcgggatccggtccgccacccgcctggagaacatcatgtggaagcagatcagcaacgagctgaaccacatcctcctggagaacgacatgaagttcaccgtggtggtcggcgacgtggcggggatcctggcccagggcaagaagatgatccggccccagcccatggagtacaagtactcctggaagtcctggggcaaggccaagatcatcggggccgacgtgcagaacaccacgttcatcatcgacggccccaacaccccggagtgccccgacgaccagcgcgcgtggaacatctgggaggtcgaggactacgggttcggcatcttcaccaccaacatctggctcaagctgcgggactcctacacccaggtgtgcgaccaccgcctgatgagcgccgccatcaaggactccaaggccgtgcacgccgacatgggctactggatcgagagcgagaagaacgagacctggaagctcgcgcgggcctccttcatcgaggtcaagacctgcatctggcccaagagccacaccctgtggtccaacggggtgctggagagcgagatgatcatccccaagatctacggcgggccgatctcccagcacaactaccgccccggctacttcacgcagaccgccgggccctggcacctcggcaagctggagctggacttcgacctctgcgagggcaccaccgtggtcgtggacgagcactgcgggaaccggggcccgagcctgcgcacgaccaccgtgaccgggaagatcatccacgagtggtgctgccggtcctgcacgctgccgcccctgcgcttcaagggcgaggacgggtgctggtacggcatggagatccggcccgtcaaggagaaggaggagaacctggtcaagagcatggtgagcgccggctccggggaggtcgacagcttctccctgggcctcctgtgcatcagcatcatgatcgaggaggtgatgcgctcccggtggagccgcaagatgctgatgaccgggaccctcgccgtgttcttcctgctgatcatgggccagctcacctggaacgacctgatccggctgtgcatcatggtcggggcgaacgcctccgaccgcatgggcatgggcacgacctacctcgccctgatggccaccttcaagatgcgcccgatgttcgccgtggggctcctgttccggcgcctgaccagccgggaggtgctgctcctgacgatcggcctgtccctcgtcgcgttcgtggagctgcccaacagcctggaggagctcggggacggcctggccatgggcatcatgatcctgaagctcctgaccgacttccagtcccaccagctgtgggccaccctcctgagcctgaccttcatcaagacgaccttctccctccactacgcctggaagaccatggcgatggtcctgagcatcgtgtccctgttccccctctgcctgagcaccacgtcccagaagaccacctggctgcccgtgctcctggggagcctgggctgcaagccgctcaccatgttcctgatcgccgagaacaagatctgggggcgcaagtcctggcccctgaacgagggcatcatggccgtcgggatcgtgagcatcctcctgagctccctgctcaagaacgacgtgcccctggccggccccctgatcgccggcgggatgctcatcgcgtgctacgtcatcagcggctccagcgccgacctgtccctggagaaggccgccgaggtgagctgggaggaggaggccgagcactccggggcgagccacaacatcctcgtggaggtccaggacgacggcacgatgaagatcaaggacgaggagcgggacgacaccctgaccatcctgctcaaggccaccctgctggccgtgtccggggtgtacccgctcagcatccccgccaccctgttcgtctggtacttctggcagaagaagaagcagcgctccggcgtgctgtgggacacgcccagcccgcccgaggtggagcgggccgtcctcgacgacggcatctaccgcatcatgcagcgggggctgctgggccgctcccaggtgggggtgggcgtcttccaggagaacgtgttccacaccatgtggcacgtgacccgcggggccgtcctgatgtaccagggcaagcgcctcgagcccagctgggcctccgtgaagaaggacctgatcagctacggcgggggctggcggctgcaggggtcctggaacaccggcgaggaggtgcaggtcatcgccgtggagcccgggaagaaccccaagaacgtgcagacggcccccggcaccttcaagaccagcgagggcgaggtcggggccatcgcgctcgacttcaagcccggcacctccgggagccccatcgtgaaccgcgagggcaagatcgtgggcctgtacgggaacggcgtcgtgacgaccagcgggacctacgtgtccgccatcgcccaggccaaggcgagccaggagggccccctgccggagatcgaggacgaggtcttccggaagcgcaacctcaccatcatggacctgcaccccgggtccggcaagacgcggcgctacctgcccgccatcgtgcgggaggccatcaagcgcaagctccggaccctgatcctggccccgacccgcgtggtcgccagcgagatggcggaggccctcaagggcatgcccatccgctaccagaccacggccgtgaagtccgagcacaccgggaaggagatcgtggacctgatgtgccacgccaccttcaccatgcggctgctcagccccgtccgcgtgcccaactacaacatgatcatcatggacgaggcccacttcacggacccgtccagcatcgcggcccggggctacatctccacccgcgtggggatgggcgaggccgccgccatcttcatgaccgcgacgccgcccgggagcgtcgaggccttcccccagtccaacgccgtgatccaggacgaggagcgggacatcccggagcgcagctggaactccggctacgagtggatcacggacttccccggcaagaccgtgtggttcgtccccagcatcaagtccgggaacgacatcgccaactgcctgcggaagaacggcaagcgcgtgatccagctgagccggaagaccttcgacaccgagtaccagaagacgaagaacaacgactgggactacgtggtcaccaccgacatctccgagatgggggcgaacttccgcgccgaccgggtgatcgacccccgccggtgcctcaagccggtgatcctgaaggacggccccgagcgcgtcatcctggccgggcccatgcccgtgaccgtcgccagcgccgcgcagcggcgcggccggatcggccgcaaccacaacaaggagggggaccagtacatctacatgggccagccgctcaacaacgacgaggaccacgcccactggacggaggccaagatgctgctggacaacatcaacacccccgaggggatcatccccgccctcttcgagcccgagcgggagaagtccgccgcgatcgacggcgagtaccgcctgcgcggggaggcccggaagaccttcgtggagctgatgcgccggggcgacctcccggtgtggctgagctacaaggtcgccagcgagggcttccagtactccgaccgccggtggtgcttcgacggggagcgcaacaaccaggtgctggaggagaacatggacgtggagatctggaccaaggagggcgagcggaagaagctccgcccccggtggctggacgcccgcacgtacagcgaccccctggccctccgggagttcaaggagttcgcggccgggcgccggtccgtcagcggcgacctgatcctggagatcggcaagctcccccagcacctgacccagcgcgcccagaacgccctggacaacctcgtgatgctgcacaactccgagcagggcgggcgggcgtaccgccacgccatggaggagctgccggacaccatcgagaccctcatgctgctggccctcatcgccgtgctgacgggcggggtcaccctgttcttcctcagcgggcgggggctgggcaagacctccatcgggctgctctgcgtgatggccagctccgtgctgctgtggatggcgagcgtcgagccccactggatcgccgcctccatcatcctcgagttcttcctgatggtgctgctcatccccgagcccgaccgccagcggaccccgcaggacaaccagctggcctacgtggtcatcggcctcctcttcatgatcctgaccgtggccgcgaacgagatggggctgctcgagacgaccaagaaggacctgggcatcgggcacgtggccgtcgagaaccaccaccacgccgccatgctggacgtggacctccaccccgccagcgcgtggaccctgtacgccgtggccaccacgatcatcacccccatgatgcgccacaccatcgagaacaccacggccaacatctccctgaccgccatcgcgaaccaggccgccatcctcatgggcctggacaagggctggccgatcagcaagatggacatcggggtccccctgctcgccctgggctgctactcccaggtgaaccccctgaccctcaccgcggccgtgctgatgctggtcgcccactacgccatcatcgggcccggcctccaggccaaggcgacgcgggaggcccagaagcgcaccgccgccgggatcatgaagaacccgaccgtggacggcatcgtggccatcgacctggaccccgtcgtgtacgacgcgaagttcgagaagcagctgggccagatcatgctcctgatcctgtgcaccagccagatcctcctgatgcgcacgacctgggccctgtgcgagtccatcaccctcgccaccgggcccctgacgaccctgtgggagggcagccccgggaagttctggaacaccaccatcgccgtgtccatggccaacatcttccggggcagctacctcgcgggcgccgggctggccttcagcctgatgaagtccctcggcgggggccgccgggggacgggcgcccagggcgagaccctgggggagaagtggaagcgccagctgaaccagctcagcaagtccgagttcaacacctacaagcggagcggcatcatggaggtcgaccgctccgaggcgaaggaggggctgaagcggggcgagaccacgaagcacgccgtgagccgcgggaccgccaagctgcggtggttcgtggagcgcaacctcgtcaagccggagggcaaggtgatcgacctgggctgcgggcggggcgggtggtcctactactgcgccggcctgaagaaggtgaccgaggtcaaggggtacaccaagggcggccccgggcacgaggagcccatccccatggccacgtacggctggaacctggtgaagctccacagcgggaaggacgtgttcttcatcccgcccgagaagtgcgacaccctgctgtgcgacatcggcgagtccagccccaaccccaccatcgaggaggggcgcaccctccgggtcctgaagatggtggagccgtggctgcgcggcaaccagttctgcatcaagatcctcaacccctacatgccctccgtggtcgagacgctggagcagatgcagcggaagcacggcgggatgctggtgcgcaaccccctcagccggaactccacccacgagatgtactgggtgagctgcggcaccgggaacatcgtctccgcggtgaacatgaccagccgcatgctgctgaaccggttcaccatggcccaccgcaagccgacgtacgagcgcgacgtggacctcggcgccggcacccggcacgtcgccgtggagcccgaggtggccaacctggacatcatcgggcagcgcatcgagaacatcaagcacgagcacaagtccacctggcactacgacgaggacaacccctacaagacctgggcgtaccacggcagctacgaggtcaagccctccgggagcgccagctccatggtgaacggcgtcgtgaagctgctcacgaagccgtgggacgtgatccccatggtcacccagatcgccatgaccgacaccacgcccttcgggcagcagcgggtgttcaaggagaaggtggacacccgcacccccaaggccaagcggggcaccgcccagatcatggaggtcacggcgaagtggctgtggggcttcctgagccgcaacaagaagccgcggatctgcacccgcgaggagttcacccggaaggtgcgctccaacgccgccatcggggccgtgttcgtcgacgagaaccagtggaacagcgcgaaggaggccgtggaggacgagcggttctgggacctcgtgcaccgcgagcgggagctgcacaagcagggcaagtgcgcgacctgcgtctacaacatgatggggaagcgcgagaagaagctgggcgagttcgggaaggccaagggctcccgggccatctggtacatgtggctcggcgcgcgcttcctggagttcgaggccctggggttcatgaacgaggaccactggttcagccgggagaactccctcagcggcgtggagggggagggcctgcacaagctggggtacatcctccgcgacatctccaagatccccggcggcaacatgtacgccgacgacacggccgggtgggacacccggatcaccgaggacgacctgcagaacgaggccaagatcaccgacatcatggagcccgagcacgcgctgctcgccaagagcatcttcaagctgacgtaccagaacaaggtggtccgcgtgcagcggccggccaagaacggcaccgtgatggacgtcatctcccgccgcgaccagcgggggagcggccaggtgggcacctacgggctgaacaccttcacgaacatggaggcccagctcatccgccagatggagtccgagggcatcttcagcccctccgagctggagacccccaacctggccgggcgggtgctcgactggctggagaagcacggcgtcgagcgcctgaagcggatggcgatcagcggggacgactgcgtggtgaagcccatcgacgaccgcttcgccaccgccctcaccgccctgaacgacatgggcaaggtccggaaggacatcccgcagtgggagccctccaagggctggaacgactggcagcaggtccccttctgcagccaccacttccaccagctgatcatgaaggacgggcgcgagatcgtggtcccctgccggaaccaggacgagctcgtgggccgcgcccgggtgagccagggggcgggctggtccctgcgcgagacggcctgcctgggcaagagctacgcccagatgtggcagctcatgtacttccaccggcgcgacctgcggctggccgcgaacgccatctgctccgccgtcccggtggactgggtgcccaccagccgcaccacctggtccatccacgcccaccaccagtggatgacgaccgaggacatgctcagcgtctggaaccgggtgtggatcgaggagaacccctggatggaggacaagacccacatctccagctggggcgacgtgccctacctgggcaagcgcgaggaccagtggtgcgggtccctgatcggcctcaccgcccgggcgacgtgggccaccaacatccaggtcgccatcaaccaggtgcgccgcctgatcgggaacgagaactacctggactacatgaccagcatgaagcggttcaagaacgagtccgacccggagggcgccctctggtga

SEQ ID NO: 8791 - RNA, 9879 nt, synthetic construct
  misc_feature 1..9879: note = derived and/or modified CDS sequence (opt1) from DENV-1__EU482528__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtcatgtgcaccgggagcttcaagctggagaaggaggtggcggagacgcagcacggcaccgtgctcgtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtcgggaagctggtgcaccagatcttcggcaccgcctacggggtgctgttcagcggcgtctcctggaccatgaagatcgggatcggcgtgctcctgacgtggctgggcctcaacagccgctccaccagcctgtccatgacctgcatcgccgtggggctggtcaccctctacctgggcgccatggtgcaggcggacagcgggtgcgtgatcaactggaagggccgggagctgaagtgcgggagcggcatcttcgtcacgaacgaggtgcacacctggaccgagcagtacaagttccaggccgactccccgaagcgcctcagcgccgccatcggcaaggcctgggaggagggggtgtgcggcatccggtccgcgacccgcctggagaacatcatgtggaagcagatcagcaacgagctgaaccacatcctcctggagaacgacatgaagttcaccgtcgtggtgggggacgtcgccggcatcctggcccaggggaagaagatgatccggccccagcccatggagtacaagcactcctggaagtcctggggcaaggccaagatcatcggcgcggacgtgcagaacacgaccttcatcatcgacgggcccaacaccccggagtgccccgacgaccagcgcgcctggaacatctgggaggtggaggactacggcttcgggatcttcaccacgaacatctggctcaagctgcgggactcctacacccaggtctgcgaccaccgcctgatgagcgccgccatcaaggactccaaggccgtgcacgcggacatgggctactggatcgagagcgagaagaacgagacctggaagctcgcccgggcctccttcatcgaggtgaagacctgcatctggcccaagagccacacgctgtggtccaacggcgtcctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtggtcgacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtgaaggagaaggaggagaacctggtcaagagcatggtgagcgccggctccggcgaggtggacagcttctccctggggctcctgtgcatcagcatcatgatcgaggaggtcatgcgctcccggtggagccgcaagatgctgatgaccggcaccctcgcggtgttcttcctgctgatcatggggcagctcacgtggaacgacctgatccggctgtgcatcatggtgggcgccaacgcctccgaccgcatggggatgggcaccacctacctcgccctgatggccaccttcaagatgcgcccgatgttcgcggtcggcctcctgttccggcgcctgacgagccgggaggtgctgctcctgaccatcgggctgtccctcgtggccagcgtcgagctgcccaactccctggaggagctcggcgacgggctggccatgggcatcatgatcctgaagctcctgaccgacttccagagccaccagctgtgggccaccctcctgtccctgacgttcatcaagaccaccttcagcctccactacgcgtggaagaccatggccatggtgctgtccatcgtcagcctgttccccctctgcctgtccacgaccagccagaagaccacctggctgcccgtgctcctgggctccctggggtgcaagccgctcacgatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgcgggcggcatgctcatcgcctgctacgtgatctccgggagctccgccgacctgagcctggagaaggccgccgaggtctcctgggaggaggaggcggagcacagcggcgcctcccacaacatcctcgtggaggtgcaggacgacgggaccatgaagatcaaggacgaggagcgggacgacaccctgaccatcctgctcaaggccaccctgctggccgtcagcggcgtgtacccgctctccatccccgccacgctgttcgtgtggtacttctggcagaagaagaagcagcgcagcggggtcctgtgggacacccccagcccgcccgaggtggagcgggcggtgctcgacgacggcatctaccgcatcatgcagcggggcctgctggggcgcagccaggtcggcgtgggggtgttccaggagaacgtcttccacaccatgtggcacgtgacccggggcgccgtgctgatgtaccaggggaagcgcctcgagccctcctgggccagcgtcaagaaggacctgatctcctacggcggcgggtggcggctgcagggcagctggaacacgggggaggaggtccaggtgatcgccgtcgagcccggcaagaaccccaagaacgtgcagaccgcccccgggaccttcaagacctccgagggcgaggtgggcgcgatcgccctcgacttcaagcccgggacgagcggcagccccatcgtcaaccgcgaggggaagatcgtgggcctgtacggcaacggggtggtcaccacctccggcacctacgtgagcgccatcgcccaggcgaaggcctcccaggaggggcccctgccggagatcgaggacgaggtgttccggaagcgcaacctcacgatcatggacctgcaccccggcagcgggaagacccggcgctacctgcccgccatcgtccgggaggccatcaagcgcaagctccggaccctgatcctggccccgacccgcgtggtggcgtccgagatggccgaggccctcaagggcatgcccatccgctaccagacgaccgccgtcaagagcgagcacaccggcaaggagatcgtggacctgatgtgccacgccaccttcacgatgcggctgctctcccccgtgcgcgtccccaactacaacatgatcatcatggacgaggcgcacttcaccgacccgagctccatcgccgcccgggggtacatcagcacccgcgtgggcatgggggaggccgccgcgatcttcatgaccgccacgccgcccggctccgtggaggccttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgcgaactgcctgcggaagaacgggaagcgcgtcatccagctgtcccggaagaccttcgacacggagtaccagaagaccaagaacaacgactgggactacgtggtgaccaccgacatcagcgagatgggcgccaacttccgcgccgaccgggtcatcgacccccgccggtgcctcaagccggtgatcctgaaggacgggcccgagcgcgtgatcctggccggccccatgcccgtcacggtggcctccgcggcccagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgcggccatcgacggggagtaccgcctgcgcggcgaggcccggaagaccttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggacgaaggagggggagcggaagaagctccgcccccggtggctggacgcccgcacctactccgaccccctggcgctccgggagttcaaggagttcgccgccggccgccggagcgtgtccggggacctgatcctggagatcggcaagctcccccagcacctgacccagcgcgcccagaacgcgctggacaacctcgtcatgctgcacaacagcgagcagggcgggcgggcctaccgccacgccatggaggagctgccggacaccatcgagacgctcatgctgctggccctcatcgccgtgctgaccggcggggtgaccctgttcttcctctccggccgggggctgggcaagaccagcatcggcctgctctgcgtcatggcgtccagcgtgctgctgtggatggcctccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgacggtcgcggccaacgagatgggcctgctcgagaccaccaagaaggacctggggatcggccacgtggccgtggagaaccaccaccacgccgccatgctggacgtcgacctccaccccgcgtccgcctggaccctgtacgccgtggccacgaccatcatcacccccatgatgcgccacaccatcgagaacacgaccgccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcacggccgccgtgctgatgctggtggcccactacgccatcatcggccccgggctccaggcgaaggccacccgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggcgaacatcttccgggggagctacctcgccggcgccggcctggccttctccctgatgaagtccctcgggggcgggcgccggggcaccggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcggccccggccacgaggagcccatccccatggcgacctacgggtggaacctggtcaagctccactccggcaaggacgtgttcttcatcccgcccgagaagtgcgacaccctgctgtgcgacatcggggagagctcccccaaccccaccatcgaggagggccgcacgctccgggtgctgaagatggtcgagccgtggctgcgcgggaaccagttctgcatcaagatcctcaacccctacatgcccagcgtggtggagaccctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcacgatggcccaccgcaagccgacctacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacgtgggcctaccacgggtcctacgaggtgaagcccagcggcagcgcctccagcatggtcaacggggtggtcaagctgctcaccaagccgtgggacgtgatccccatggtgacccagatcgccatgaccgacacgacccccttcggccagcagcgggtcttcaaggagaaggtggacacccgcacccccaaggccaagcgggggacggcgcagatcatggaggtgaccgccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcaccgaggacgacctgcagaacgaggcgaagatcacggacatcatggagcccgagcacgccctgctcgccaagtccatcttcaagctgacctaccagaacaaggtggtgcgcgtccagcggccggccaagaacgggaccgtgatggacgtgatcagccgccgcgaccagcggggctccgggcaggtcggcacctacggcctgaacacgttcaccaacatggaggcccagctcatccgccagatggagagcgaggggatcttctcccccagcgagctggagacccccaacctggcgggccgggtgctcgactggctggagaagcacggggtggagcgcctgaagcggatggccatctccggcgacgactgcgtcgtgaagcccatcgacgaccgcttcgccaccgccctcacggccctgaacgacatggggaaggtgcggaaggacatcccgcagtgggagcccagcaagggctggaacgactggcagcaggtccccttctgcagccaccacttccaccagctgatcatgaaggacggccgcgggatcgtggtgccctgccggaaccaggacgagctcgtcggccgcgcgcgggtgtcccagggggccggctggagcctgcgcgagaccgcctgcctggggaagtcctacgcccagatgtggcagctcatgtacttccaccggcgcgacctgcggctggcggccaacgccatctgcagcgccgtgccggtcgactgggtgcccacctcccgcaccacgtggagcatccacgcccaccaccagtggatgaccaccgaggacatgctctccgtgtggaaccgggtctggatcgaggagaacccctggatggaggacaagacccacatcagctcctggggcgacgtgccctacctgggcaagcgcgaggaccagtggtgcgggagcctgatcggcctcacggcgcgggccacctgggccaccaacatccaggtggccatcaaccaggtccgccgcctgatcgggaacgagaactacctggactacatgacctccatgaagcggttcaagaacgagagcgacccggagggcgccctctggtga

SEQ ID NO: 8792 - RNA, 9879 nt, synthetic construct
  misc_feature 1..9879: note = derived and/or modified CDS sequence (opt1) from DENV-1__EU482529__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgctgcaggagacctggaaccggcaggacctgctcgtgaccttcaagaccgcccacgccaagaagcaggaggtcgtggtgctgggctcccaggagggcgcgatgcacacggccctgaccggggccaccgagatccagaccagcggcacgaccaccatcttcgccgggcacctcaagtgccgcctgaagatggacaagctgaccctcaagggcatgtcctacgtcatgtgcacggggagcttcaagctggagaaggaggtggccgagacccagcacggcaccgtgctggtccagatcaagtacgagggcaccgacgcgccctgcaagatccccttctccacgcaggacgagaagggggtgacccagaacggccggctgatcaccgccaacccgatcgtgaccgacaaggagaagcccgtcaacatcgaggccgagccgcccttcggggagagctacatcatcatcggcgccggcgagaaggcgctcaagctgtcctggttcaagaaggggagctccatcggcaagatgttcgaggccacggcccgcggggcccggcgcatggccatcctgggcgacaccgcgtgggacttcgggagcatcggcggcgtgttcacctccgtggggaagctcgtccaccagatcttcggcaccgcctacggggtgctgttcagcggcgtgtcctggacgatgaagatcgggatcggcgtcctgctcacctggctgggcctgaacagccgctccaccagcctctccatgacctgcatcgccgtggggctggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgtcgccggcatcctggcgcaggggaagaagatgatccggccccagcccatggagtacaagtactcctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggactcccacacccaggtctgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatctacgggggcccgatctcccagcacaactaccgccccgggtacttcacccagaccgccggcccctggcacctggggaagctcgagctggacttcgacctgtgcgagggcacgaccgtggtggtcgacgagcactgcggcaaccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtcaagagcatggtgtccgccggcagcggcgaggtggacagcttctccctggggctgctctgcatcagcatcatgatcgaggaggtcatgcggtcccgctggagccggaagatgctgatgaccggcacgctggccgtgttcttcctcctgatcatggggcagctgacctggaacgacctcatccgcctgtgcatcatggtgggcgccaacgcgtccgaccgcatggggatgggcaccacctacctggccctcatggccacgttcaagatgcggccgatgttcgccgtcggcctgctgttccgccggctcaccagccgcgaggtgctgctgctcaccatcgggctgtccctggtggccagcgtcgagctccccaactccctggaggagctgggcgacgggctcgcgatgggcatcatgatcctgaagctgctcaccgacttccagagccaccagctgtgggccacgctgctctccctgaccttcatcaagaccaccttcagcctgcactacgcctggaagacgatggccatggtgctctccatcgtcagcctgttccccctgtgcctctccaccaccagccagaagaccacgtggctgcccgtgctgctcggctccctggggtgcaagccgctgaccatgttcctcatcgcggagaacaagatctggggccggcgcagctggcccctgaacgaggggatcatggccgtgggcatcgtctccatcctgctcagcagcctgctgaagaacgacgtgcccctcgccgggcccctgatcgccggcggcatgctgatcgcctgctacgtgatctccgggagctccgcggacctcagcctggagaaggccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgctgtccatccccgccaccctcttcgtgtggtacttctggcagaagaagaagcagcgcagcggggtcctgtgggacacccccagcccgcccgaggtggagcgggccgtgctggacgacggcatctaccgcatcatgcagcggggcctgctcgggcgcagccaggtcggcgtgggggtgttccaggagaacgtcttccacaccatgtggcacgtgacgcggggcgccgtgctgatgtaccaggggaagcgcctggagccctcctgggcgagcgtcaagaaggacctcatctcctacggcggcgggtggcggctgcagggcagctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggacctccggcagccccatcgtcaaccgcgaggggaagatcgtgggcctctacggcaacggggtggtcaccacctccggcacgtacgtgagcgcgatcgcccaggccaaggccagccaggaggggccgctgcccgagatcgaggacgaggtgttccggaagcgcaacctgaccatcatggacctccaccccggctccgggaagacccggcgctacctgccggcgatcgtccgggaggccatcaagcgcaagctgcgcaccctcatcctggcccccacgcgggtggtggccagcgagatggccgaggcgctgaagggcatgcccatccgctaccagaccaccgccgtcaagtccgagcacaccggcaaggagatcgtggacctcatgtgccacgccacgttcaccatgcggctgctgagccccgtgcgcgtcccgaactacaacatgatcatcatggacgaggcccacttcaccgacccctccagcatcgccgcgcgggggtacatctccacccgcgtgggcatgggggaggccgccgccatcttcatgacggccacgccgcccggcagcgtggaggcgttcccgcagtccaacgccgtcatccaggacgaggagcgggacatccccgagcgcagctggaactccgggtacgagtggatcaccgacttccccggcaagaccgtgtggttcgtgcccagcatcaagtccggcaacgacatcgccaactgcctccggaagaacgggaagcgcgtcatccagctgagccggaagacgttcgacaccgagtaccagaagaccaagaacaacgactgggactacgtggtgaccacggacatctccgagatgggcgccaacttccgcgcggaccgggtcatcgacccgcgccggtgcctgaagcccgtgatcctcaaggacgggcccgagcgcgtgatcctggccggccccatgccggtcaccgtggccagcgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctcagctacaaggtggcctccgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctacagcgaccccctggccctgcgggagttcaaggagttcgccgcgggccgccggtccgtgagcggggacctcatcctggagatcggcaagctgccgcagcacctcacccagcgcgcccagaacgccctggacaacctggtcatgctccacaactccgagcagggcgggcgggcctaccgccacgcgatggaggagctgcccgacacgatcgagaccctgatgctcctggccctgatcgccgtgctcaccggcggggtgaccctgttcttcctgagcggccgggggctcggcaagacctccatcggcctgctgtgcgtcatggccagctccgtgctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgccagcgcctggacgctctacgcggtggccaccaccatcatcaccccgatgatgcgccacacgatcgagaacaccaccgccaacatctccctgaccgccatcgccaaccaggcggccatcctgatggggctcgacaagggctggcccatcagcaagatggacatcggcgtgcccctgctggccctcgggtgctactcccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcaccagccagatcctgctcatgcgcaccacctgggcgctgtgcgagtccatcacgctggccaccggccccctcaccaccctgtgggaggggagcccgggcaagttctggaacacgaccatcgccgtgtccatggccaacatcttccgggggagctacctggccggcgcgggcctcgccttctccctgatgaagtccctcgggggcgggcgccgggggaccggggcccagggcgagaccctcggcgagaagtggaagcgccagctgaaccagctgagcaagtccgagttcaacacgtacaagcggagcgggatcatggaggtggaccgctccgaggccaaggagggcctcaagcgcggggagaccaccaagcacgcggtcagccgcggcaccgccaagctgcggtggttcgtggagcgcaacctggtgaagcccgaggggaaggtcatcgacctgggctgcggccgcggcgggtggtcctactactgcgccgggctcaagaaggtgacggaggtgaaggggtacaccaagggcggccccggccacgaggagcccatcccgatggccacctacgggtggaacctggtcaagctgcacagcggcaaggacgtgttcttcatcccgcccgagaagtgcgacaccctcctgtgcgacatcggggagtccagccccaacccgacgatcgaggagggccgcaccctgcgggtgctcaagatggtcgagccctggctgcgcgggaaccagttctgcatcaagatcctgaacccctacatgccctccgtggtggagaccctcgagcagatgcagcggaagcacggcggcatgctggtccgcaacccgctgagccggaactccacccacgagatgtactgggtgagctgcgggaccggcaacatcgtgtccgccgtcaacatgacgagccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgagccgcaacaagaagccccggatctgcacccgcgaggagttcacgcggaaggtccgctccaacgcggccatcggcgccgtgttcgtggacgagaaccagtggaacagcgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcccgcttcctcgagttcgaggcgctgggcttcatgaacgaggaccactggttcagccgggagaactccctgagcggggtcgagggcgaggggctccacaagctgggctacatcctgcgcgacatctccaagatccccgggggcaacatgtacgccgacgacaccgccggctgggacacccggatcacggaggacgacctccagaacgaggcccgcatcaccgacatcatggagccggagcacgccctgctggccaagagcatcttcaagctcacctaccagaacaaggtggtgcgcgtccagcggcccgccaagaacgggaccgtgatggacgtgatctcccgccgggaccagcgcggcagcgggcaggtcggcacgtacggcctgaacaccttcaccaacatggaggcccagctgatccggcagatggagtccgaggggatcttcagcccctccgagctcgagacccccaacctggccgagcgcgtgctggactggctcgagaagtacggcgtggagcggctgaagcgcatggccatcagcggggacgactgcgtcgtgaagccgatcgacgaccggttcgcgacggccctgaccgccctcaacgacatgggcaaggtgcgcaaggacatcccccagtgggagccctccaaggggtggaacgactggcagcaggtccccttctgcagccaccacttccaccagctgatcatgaaggacggccgggagatcgtggtgccgtgccgcaaccaggacgagctggtcggccgggcccgcgtgtcccagggggccggctggagcctccgggagaccgcgtgcctgggcaagagctacgcccagatgtggcagctgatgtacttccaccgccgggacctccgcctggccgccaacgcgatctgctccgccgtgcccgtcgactggatccccaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccgtacctcgggaagcgcgaggaccagtggtgcggctccctgatcggcctgaccgcccgggccacctgggcgaccaacatccaggtggccatcaaccaggtgcgccggctcatcgggaacgagaactacctggactacatgaccagcatgaagcgcttcaagaacgagggcgaccccgagggggccctgtggtga

SEQ ID NO: 8793 - RNA, 9879 nt, synthetic construct
  misc_feature 1..9879: note = derived and/or modified CDS sequence (opt1) from DENV-1__EU482531__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccacgttcatcatcgacgggcccaacaccccggagtgccccaacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacaccctgtggagcaacggcgtgctcgagtccgagatggtgatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagcgggacgacaccctgaccatcctgctcaaggcgaccctgctggccgtctccggcgtgtacccgctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctgcccgagatcgaggacgaggtgttccggaagcgcaacctcaccatcatggacctgcaccccggcagcgggaagacgcggcgctacctgccggcgatcgtccgggaggccatcaagcgcaagctccggaccctgatcctggcccccacccgcgtggtggcctccgagatggccgaggcgctcaagggcatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggacggaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgacgggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatggggctggacaagggctggcccatctccaagatggacatcggcgtgcccctgctcgccctggggtgctacagccaggtcaaccccctgaccctcacggccgccgtgctgatgctggtggcgcactacgccatcatcggcccggggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggccccctgaccaccctgtgggaggggtccccgggcaagttctggaacaccacgatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggacgctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggcccagctcatccggcagatggagagcgaggggatcttcctgccctccgagctggagacccccaacctcgccgagcgcgtgctggactggctggagaagcacggcgtggagcggctcaagcgcatggccatcagcggggacgactgcgtcgtgaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctggggcgacgtgccgtacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8794 - RNA, 9879 nt, synthetic construct
  misc_feature 1..9879: note = derived and/or modified CDS sequence (opt1) from DENV-1__EU482532__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgcgggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggagcgtggccctggcgccccacgtgggcctcgggctggagacgcgcaccgagacctggatgagctccgagggcgcctggaagcagatccagcgggtcgagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccaccacccgcctggagaacatcatgtggaagcagatcagcaacgagctgaaccacatcctcctggagaacgacatgaagttcaccgtggtggtcggggacgtggccggcatcctggcgcaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggactcccacacccaggtgtgcgaccaccgcctgatgagcgcggccatcaaggactccaaggccgtgcacgccgacatgggctactggatcgagagcgagaagaacgagacctggaagctcgcccgggcgtccttcatcgaggtcaagacctgcatctggcccaagagccacacgctgtggtccaacggcgtgctggagagcgagatgatcatccccaagatctacgggggcccgatctcccagcacaactaccgcagcgggtacttcacccagaccgccggcccctggcacctcgggaagctggagctggacttcgacctctgcgagggcaccacggtggtcgtggacgagcactgcggcaaccgggggccctccctgcgcaccaccaccgtgacgggcaagatcatccacgagtggtgctgccggagctgcaccctgccgcccctccgcttcaagggggaggacggctgctggtacgggatggagatccggcccgtcaaggagaaggaggagaacctggtcaagagcatggtgtccgccggcagcggcgaggtcgactccttcagcctggggctcctgtgcatctccatcatgatcgaggaggtgatgcgcagccggtggtcccgcaagatgctgatgaccggcaccctcgccgtgttcttcctgctgatcatggggcagctcacgtggaacgacctgatccggctgtgcatcatggtcggcgccaacgcgagcgaccgcatggggatgggcaccacctacctcgccctgatggccaccttcaagatgcgccccatgttcgccgtgggcctcctgttccggcgcctgacgtcccgggaggtgctgctcctgaccatcgggctgagcctcgtcgcctccgtggagctgccgaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtcctgagcatcgtgtccctgttccccctctgcctgagcacgacctcccagaagaccacctggctgcccgtgctcctgggcagcctggggtgcaagcccctcacgatgttcctgatcgcggagaacaagatctggggccgcaagagctggccgctgaacgaggggatcatggccgtcggcatcgtgtccatcctcctgagctccctgctcaagaacgacgtgcccctggccgggcccctgatcgccggcggcatgctcatcgcctgctacgtcatcagcgggtccagcgcggacctgtccctggagaaggccgccgaggtgagctgggaggaggaggccgagcactccggcgccagccacaacatcctcgtggaggtccaggacgacgggaccatgaagatcaaggacgaggagcgggacgacaccctgaccatcctgctcaaggcgaccctgctggccgtgtccggcgtgtaccccctcagcatcccggccacgctgttcgtctggtacttctggcagaagaagaagcagcgctccggggtgctgtgggacaccccctccccgcccgaggtggagcgggccgtcctcgacgacggcatctaccgcatcatgcagcggggcctgctggggcgctcccaggtgggcgtgggggtcttccaggagaacgtgttccacaccatgtggcacgtgacccggggcgccgtcctgatgtaccaggggaagcgcctcgagccgagctgggcgtccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagaccagcgagggcgaggtcggcgccatcgccctcgacttcaagccggggacgagcggctcccccatcgtgaaccgcgaggggaagatcgtgggcctgtacggcaacggggtcgtgaccaccagcggcacctacgtgtccgcgatcgcccaggccaaggccagccaggaggggcccctgcccgagatcgaggacgaggtcttccggaagcgcaacctcacgatcatggacctgcacccgggctccgggaagacccggcgctacctgcccgcgatcgtgcgggaggccatcaagcgcaagctccggaccctgatcctggcccccacccgcgtggtcgccagcgagatggccgaggcgctcaagggcatgccgatccgctaccagacgaccgccgtgaagtccgagcacaccggcaaggagatcgtggacctgatgtgccacgccaccttcacgatgcggctgctcagccccgtccgcgtgcccaactacaacatgatcatcatggacgaggcccacttcaccgacccctccagcatcgccgcgcgggggtacatctccacccgcgtgggcatgggggaggccgccgccatcttcatgaccgccacgccgcccggcagcgtcgaggcgttcccccagtccaacgccgtgatccaggacgaggagcgggacatccccgagcgcagctggaactccgggtacgagtggatcaccgacttcccgggcaagaccgtgtggttcgtccccagcatcaagtccggcaacgacatcgccaactgcctgcggaagaacgggaagcgcgtgatccagctgagccggaagaccttcgacacggagtaccagaagaccaagaacaacgactgggactacgtggtcaccaccgacatctccgagatgggcgccaacttccgcgcggaccgggtgatcgacccccgccggtgcctcaagcccgtgatcctgaaggacgggccggagcgcgtcatcctggccggccccatgcccgtgacggtcgccagcgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacaccccggagggcatcatccccgccctcttcgagcccgagcgggagaagtccgccgccatcgacggggagtaccgcctgcgcggcgaggcgcggaagaccttcgtggagctgatgcgccgcggggacctccccgtgtggctgtcctacaaggtcgccagcgagggcttccagtactccgaccgccggtggtgcttcgacggcgagcgcaacaaccaggtgctggaggagaacatggacgtggagatctggacgaaggagggggagcggaagaagctccgcccgcggtggctggacgcccgcacctacagcgaccccctggccctccgggagttcaaggagttcgccgcgggccgccggtccgtcagcggggacctgatcctggagatcggcaagctcccccagcacctgacccagcgcgcccagaacgccctggacaacctcgtgatgctgcacaactccgagcagggcgggcgggcctaccgccacgcgatggaggagctgcccgacaccatcgagacgctcatgctgctggccctcatcgccgtgctgaccggcggggtcaccctgttcttcctcagcggccgggggctgggcaagacctccatcggcctgctctgcgtgatggccagctccgtgctgctgtggatggccagcgtcgagccgcactggatcgcggcctccatcatcctcgagttcttcctgatggtgctgctcatccccgagcccgaccgccagcggacgccccaggacaaccagctggcctacgtggtcatcgggctcctgttcatgatcctgacggtggccgccaacgagatgggcctgctcgagaccaccaagaaggacctggggatcggccacgtggcggccgagaaccaccaccacgccgccatgctggacgtcgacctccacccggccagcgcgtggaccctgtacgccgtggccacgaccatcatcacccccatgatgcgccacaccatcgagaacacgaccgccaacatctccctgaccgccatcgcgaaccaggccgccatcctcatggggctggacaagggctggcccatcagcaagatggacatcggcgtgccgctgctcgccctggggtgctactcccaggtcaaccccctgaccctcacggcggccgtgctgatgctggtggcccactacgccatcatcggccccgggctccaggccaaggcgacccgggaggcccagaagcgcaccgccgccggcatcatgaagaaccccaccgtcgacgggatcgtggccatcgacctggacccggtggtctacgacgcgaagttcgagaagcagctgggccagatcatgctcctgatcctgtgcacgagccagatcctcctgatgcgcaccacctgggccctgtgcgagtccatcaccctcgccacgggccccctgaccaccctgtgggaggggagccccggcaagttctggaacaccacgatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctcagcaagtccgagttcaacacctacaagcggagcgggatcatggaggtggaccgctccgaggcgaaggagggcctgaagcgcggggagacgaccaagcacgccgtcagccgcggcaccgccaagctgcggtggttcgtggagcgcaacctcgtgaagcccgaggggaaggtcatcgacctgggctgcggccgcggcgggtggtcctactactgcgccgggctgaagaaggtgaccgaggtgaaggggtacacgaagggcgggccgggccacgaggagcccatccccatggccacctacgggtggaacctggtcaagctccacagcggcaaggacgtgttcttcatcccgcccgagaagtgcgacaccctgctgtgcgacatcggggagtccagccccaaccccaccatcgaggagggccgcacgctccgggtgctgaagatggtcgagccctggctgcgcgggaaccagttctgcatcaagatcctcaacccctacatgccctccgtggtggagaccctggagcagatgcagcggaagcacggcggcatgctggtccgcaaccccctcagccggaactccacccacgagatgtactgggtgagctgcgggaccggcaacatcgtgtccgcggtcaacatgaccagccgcatgctgctgaaccggttcacgatggcccaccgcaagcccacctacgagcgcgacgtggacctcggggccggcacccggcacgtggccgtcgagccggaggtggccaacctggacatcatcggccagcgcatcgagaacatcaagcacgagcacaagtccacctggcactacgacgaggacaacccctacaagacgtgggcgtaccacgggagctacgaggtgaagcccagcggctccgccagctccatggtcaacggggtggtcaagctgctcaccaagccctgggacgtgatcccgatggtgacccagatcgccatgaccgacacgacccccttcggccagcagcgggtcttcaaggagaaggtggacacccgcacccccaaggccaagcgggggacggcccagatcatggaggtgaccgcgaagtggctgtggggcttcctgagccgcaacaagaagccccggatctgcacccgcgaggagttcacccggaaggtccgctccaacgccgccatcggcgccgtgttcgtggacgagaaccagtggaacagcgcgaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtcgagggcgaggggctgcacaagctgggctacatcctccgcgacatctccaagatccccgggggcaacatgtacgccgacgacaccgccggctgggacacccggatcaccgaggacgacctgcagaacgaggccaagatcacggacatcatggagcccgagcacgcgctgctcgccaagagcatcttcaagctgacctaccagaacaaggtggtgcgcgtccagcggcccgccaagaacgggaccgtgatggacgtgatctcccgccgcgaccagcggggcagcgggcaggtcggcacctacggcctgaacacgttcaccaacatggaggcccagctcatccgccagatggagtccgaggggatcttcagcccgtccgagctggagacccccaacctggccggccgggtgctcgactggctggagaagcacggggtggagcgcctgaagcggatggcgatcagcggcgacgactgcgtcgtgaagcccatcgacgaccgcttcgccaccgccctcacggccctgaacgacatggggaaggtgcggaaggacatcccccagtgggagccgagcaagggctggaacgactggcagcaggtccccttctgctcccaccacttccaccagctgatcatgaaggacggccgcgagatcgtggtgccctgccggaaccaggacgagctcgtcgggcgcgcccgggtgagccagggcgcggggtggtccctgcgcgagaccgcctgcctgggcaagagctacgcccagatgtggcagctcatgtacttccaccggcgcgacctgcggctggccgcgaacgccatctgctccgccgtgcccgtcgactgggtgccgaccagccgcaccacgtggtccatccacgcccaccaccagtggatgaccaccgaggacatgctcagcgtgtggaaccgggtctggatcgaggagaacccctggatggaggacaagacccacatctccagctggggcgacgtgccctacctgggcaagcgcgaggaccagtggtgcggctccctgatcgggctcacggcccgggcgacctgggccaccaacatccaggtggccatcaaccaggtccgccgcctgatcggcaacgagaactacctggactacatgaccagcatgaagcggttcaagaacgagtccgaccccgagggggccctctggtga

SEQ ID NO: 8795 - RNA, 9879 nt, synthetic construct
  misc_feature 1..9879: note = derived and/or modified CDS sequence (opt1) from DENV-1__EU482533__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagaccgtccagtacgagaacctgaagtacagcgtgatcgtgaccgtccacacgggcgaccagcaccaggtggggaacgagtccaccgagcacggcaccaccgcgaccatcacgccccaggcccccagcaccgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggaccagcggggcctccaccagccaggagacgtggaaccggaaggacctcctggtgaccttcaagaccgcccacgcgaagaagcaggaggtcatcgtgctgggctcccaggagggcgccatgcacaccgccctcacgggggccaccgagatccagaccagcggcaccacgaccatcttcgccgggcacctgaagtgccgcctgaagatggacaagctcaccctgaagggcatgtcctacgtgatgtgcaccgggagcttcaagctggagaaggaggtcgcggagacgcagcacggcaccgtgctcgtgcagatcaagtacgagggcaccgacgccccctgcaagatccccttctccacccaggacgagaagggggtcacgcagaacggccggctgatcaccgccaacccgatcgtgaccgacaaggagaagcccgtgaacatcgaggccgagccgcccttcggggagagctacatcgtcatcggcgcgggcgagaaggccctgaagctgtcctggttcaagaaggggagctccatcggcaagatgttcgaggccaccgcccgcggggcccggcgcatggcgatcctcggcgacacggcctgggacttcgggagcatcggcggcgtgttcacctccgtggggaagctggtccaccagatcttcggcaccgcctacggggtgctgttcagcggcgtgtcctggaccatgaagatcgggatcggcgtcctcctgacgtggctgggcctcaacagccgctccaccagcctgtccatgacctgcatcgccgtggggctggtgaccctctacctgggcgtcatggtgcaggccgacagcgggtgcgtgatcaactggaagggccgggagctgaagtgcgggagcggcatcttcgtcacgaacgaggtgcacacctggaccgagcagtacaagttccaggcggactccccgaagcgcctcagcgccgccatcggcaaggcctgggaggagggggtgtgcggcatccggtccgccacccgcctggagaacatcatgtggaagcagatcagcaacgagctgaaccacatcctcctggagaacgacatgaagttcaccgtcgtggtgggggacgtcgcgggcatcctggcccaggggaagaagatgatccggccccagcccatggagtacaagtactcctggaagtcctggggcaaggccaagatcatcggcgccgacgtgcagaacgcgacgttcatcatcgacgggcccaacaccccggagtgccccgacgaccagcgcgcctggaacatctgggaggtggaggactacggcttcgggatcttcaccaccaacatctggctcaagctgcgggactcctacacgcaggtctgcgaccaccgcctgatgagcgccgccatcaaggactccaaggccgtgcacgcggacatgggctactggatcgagagcgagaagaacgagacctggaagctcgcccgggcctccttcatcgaggtgaagacctgcatctggcccaagagccacaccctgtggtccaacggcgtcctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtggtggtcgacgagcactgcggcaaccgggggccgagcctgcgcacgaccaccgtgaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtgagcgccggctccggcgaggtggacagcttctccctggggctcctgtgcatcagcatcatgatcgaggaggtcatgcgctcccggtggagccgcaagatgctgatgaccggcaccctcgcggtgttcttcctgctgatcatggggcagctcacctggaacgacctgatccggctgtgcatcatggtgggcgccaacgcctccgaccgcatggggatgggcacgacctacctcgccctgatggccaccttcaagatgcgcccgatgttcgcggtcggcctcctgttccggcgcctgaccagccgggaggtgctgctcctgacgatcgggctgtccctcgtggccagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcgtggaagaccatggccatggtgctgtccatcgtcagcctgttccccctctgcctgtccaccacgagccagaagaccacctggctgcccgtgctcctgggctccctggggtgcaagccgctcaccatgttcctgatcgccgagaacaagatctggggccgcaagagctggcccctgaacgaggggatcatggccgtgggcatcgtcagcatcctcctgtccagcctgctcaagaacgacgtgcccctggccgggcccctgatcgcgggcggcatgctcatcgcctgctacgtgatctccgggagctccgccgacctgagcctggagaaggccgccgaggtctcctgggaggaggaggcggagcacagcggcgcctcccacaacatcctcgtggaggtgcaggacgacgggacgatgaagatcaaggacgaggagcgggacgacaccctgaccatcctgctcaaggccaccctgctggccgtcagcggcgtgtacccgctctccatccccgccaccctgttcgtgtggtacttctggcagaagaagaagcagcgcagcggggtcctgtgggacacgcccagcccgcccgaggtggagcgggcggtgctcgacgacggcatctaccgcatcatgcagcggggcctgctggggcgcagccaggtcggcgtgggggtgttccaggagaacgtcttccacaccatgtggcacgtgacccggggcgccgtgctgatgtaccaggggaagcgcctcgagccctcctgggccagcgtcaagaaggacctgatctcctacggcggcgggtggcggctgcagggcagctggaacaccggggaggaggtccaggtgatcgccgtcgagcccggcaagaaccccaagaacgtgcagacggcccccgggaccttcaagacctccgagggcgaggtgggcgcgatcgccctcgacttcaagcccgggaccagcggcagccccatcgtcaaccgcgaggggaagatcgtgggcctgtacggcaacggggtggtcacgacctccggcacctacgtgagcgccatcgcccaggcgaaggcctcccaggaggggcccctgccggagatcgaggacgaggtgttccggaagcgcaacctcaccatcatggacctgcaccccggcagcgggaagacgcggcgctacctgcccgccatcgtccgggaggccatcaagcgcaagctccggaccctgatcctggccccgacccgcgtggtggcgtccgagatggccgaggccctcaagggcatgcccatccgctaccagaccacggccgtcaagagcgagcacaccggcaaggagatcgtggacctgatgtgccacgccaccttcaccatgcggctgctctcccccgtgcgcgtccccaactacaacatgatcatcatggacgaggcgcacttcacggacccgagctccatcgccgcccgggggtacatcagcacccgcgtgggcatgggggaggccgccgcgatcttcatgaccgccacgccgcccggctccgtggaggccttcccccagagcaacgccgtcatccaggacgaggagcgggacatcccggagcgctcctggaacagcgggtacgagtggatcacggacttccccggcaagaccgtgtggttcgtgccctccatcaagagcggcaacgacatcgcgaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgccgaccgggtcatcgacccccgccggtgcctcaagccggtgatcctgaaggacgggcccgagcgcgtgatcctggccggccccatgcccgtcaccgtggcctccgcggcccagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgcggccatcgacggggagtaccgcctgcgcggcgaggcccggaagaccttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggcgctccgggagttcaaggagttcgccgccggccgccggagcgtgtccggggacctgatcctggagatcggcaagctcccccagcacctgacccagcgcgcccagaacgcgctggacaacctcgtcatgctgcacaacagcgagcagggcgggcgggcctaccgccacgccatggaggagctgccggacaccatcgagaccctcatgctgctggccctcatcgccgtgctgacgggcggggtgaccctgttcttcctctccggccgggggctgggcaagaccagcatcggcctgctctgcgtcatggcgtccagcgtgctgctgtggatggcctccgtggagccccactggatcgccgccagcatcatcctcgagttcttcctgatggtcctgctcatccccgagcccgaccgccagcggaccccgcaggacaaccagctggcctacgtggtgatcgggctcctcttcatgatcctgaccgtcgcggccaacgagatgggcctgctcgagacgaccaagaaggacctggggatcggccacgtggccgtggagaaccaccaccacgccgccatgctggacgtcgacctccaccccgcgtccgcctggaccctgtacgccgtggccaccacgatcatcacccccatgatgcgccacaccatcgagaacaccacggccaacatcagcctgaccgcgatcgccaaccaggccgccatcctcatggggctggacaagggctggccgatctccaagatggacatcggcgtgcccctgctcgcgctggggtgctacagccaggtcaaccccctgaccctcaccgccgccgtgctgatgctggtggcccactacgccatcatcggccccgggctccaggcgaaggccacgcgggaggcccagaagcgcaccgccgccggcatcatgaagaacccgaccgtcgacgggatcgtggcgatcgacctggaccccgtggtctacgacgccaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggcgaacatcttccgggggagctacctcgccggcgccggcctggccttctccctgatgaagtccctcgggggcgggcgccggggcacgggggcgcagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacaccaagggcgggcccggccacgaggagcccatccccatggcgacgtacgggtggaacctggtcaagctccactccggcaaggacgtgttcttcatcccgcccgagaagtgcgacaccctgctgtgcgacatcggggagagctcccccaaccccaccatcgaggagggccgcaccctccgggtgctgaagatggtcgagccgtggctgcgcgggaaccagttctgcatcaagatcctcaacccctacatgcccagcgtggtggagacgctggagcagatgcagcggaagcacggcggcatgctggtccgcaaccccctctcccggaacagcacccacgagatgtactgggtgtcctgcgggaccggcaacatcgtgagcgccgtcaacatgacctcccgcatgctgctgaaccggttcaccatggcccaccgcaagccgacgtacgagcgcgacgtggacctcggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagcccagcggcagcgcctccagcatggtcaacggggtggtcaagctgctcacgaagccgtgggacgtgatccccatggtgacccagatcgccatgaccgacaccacgcccttcggccagcagcgggtcttcaaggagaaggtggacacccgcacccccaaggccaagcgggggaccgcgcagatcatggaggtgacggccaagtggctgtggggcttcctgtcccgcaacaagaagccgcggatctgcacccgcgaggagttcacccggaaggtccgcagcaacgccgccatcggcgcggtgttcgtggacgagaaccagtggaactccgccaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggcgatctggtacatgtggctcggcgcccgcttcctggagttcgaggccctgggcttcatgaacgaggaccactggttctcccgggagaacagcctctccggggtcgagggcgaggggctgcacaagctgggctacatcctccgcgacatcagcaagatccccgggggcaacatgtacgccgacgacacggccggctgggacacccggatcaccgaggacgacctgcagaacgaggcgaagatcaccgacatcatggagcccgagcacgccctgctcgccaagtccatcttcaagctgacgtaccagaacaaggtggtgcgcgtccagcggccggccaagaacgggaccgtgatggacgtgatcagccgccgcgaccagcggggctccgggcaggtcggcacctacggcctgaacaccttcacgaacatggaggcccagctcatccgccagatggagagcgaggggatcttctcccccagcgagctggagacccccaacctggcgggccgggtgctcgactggctggagaagcacggggtggagcgcctgaagcggatggccatctccggcgacgactgcgtcgtgaagcccatcgacgaccgcttcgccaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtggtgccctgccggaaccaggacgagctcgtcgggcgcgcgcgggtgtcccagggcgccgggtggagcctgcgcgagacggcctgcctgggcaagtcctacgcccagatgtggcagctcatgtacttccaccggcgcgacctgcggctggcggccaacgccatctgcagcgccgtgccggtcgactgggtgcccacctcccgcaccacctggagcatccacgcccaccaccagtggatgacgaccgaggacatgctctccgtgtggaaccgggtctggatcgaggagaacccctggatggaggacaagacccacatcagctcctggggcgacgtgccctacctgggcaagcgcgaggaccagtggtgcggcagcctgatcgggctcaccgcgcgggccacgtgggccaccaacatccaggtggccatcaaccaggtccgccgcctgatcggcaacgagaactacctggactacatgacctccatgaagcggttcaagaacgagagcgacccggagggggccctctggtga

SEQ ID NO: 8796 - RNA, 9879 nt, synthetic construct
  misc_feature 1..9879: note = derived and/or modified CDS sequence (opt1) from DENV-1__EU482534__SS-prME
  source 1..9879: mol_type = other RNA
agcgtgaccatgctgctgatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcgtccgcacgaccttcagcctgcactacgcctggaagaccatggcgatggtgctgtccatcgtgagcctcttccccctgtgcctgtccaccacgagccagaagaccacctggctccccgtcctgctgggctccctcgggtgcaagccgctgaccatgttcctgatcgccgagaacaagatctggggccgcaagagctggcccctcaacgaggggatcatggccgtgggcatcgtgagcatcctgctgtccagcctcctgaagaacgacgtccccctggccgggcccctcatcgccggcggcatgctgatcgcgtgctacgtgatctccgggagctccgccgacctgagcctcgagaaggccgccgtggtctcctgggaggaggaggccgagcacagcggcgcgtcccacaacatcctggtggaggtgcaggacgacgggacgatgaagatcaaggacgaggagcgcgacgacaccctgaccatcctcctgaaggccaccctgctcgccgtcagcggcgtgtacccgctgtccatccccgccaccctgttcgtgtggtacttctggcagaagaagaagcagcggagcggggtcctctgggacacgcccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgcggtgctcatgtaccaggggaagcggctggagccctcctgggccagcgtcaagaaggacctgatctcctacggcggcgggtggcgcctccagggcagctggaacaccggggaggaggtccaggtgatcgccgtcgagcccggcaagaaccccaagaacgtgcagacggcccccgggaccttcaagacctccgagggcgaggtgggcgccatcgcgctggacttcaagcccgggaccagcggcagccccatcgtcaaccgggaggggaagatcgtgggcctgtacggcaacggggtggtcacgacctccggcacctacgtgagcgccatcgcccaggccaaggcgtcccaggaggggcccctcccggagatcgaggacgaggtgttccgcaagcggaacctgaccatcatggacctgcaccccggcagcgggaagacgcgccggtacctccccgccatcgtccgcgaggccatcaagcggaagctgcgcaccctgatcctcgccccgacccgcgtggtggcctccgagatggcggaggccctgaagggcatgcccatccggtaccagaccacggccgtcaagagcgagcacaccggcaaggagatcgtggacctgatgtgccacgccaccttcaccatgcgcctcctgtcccccgtgcgggtccccaactacaacatgatcatcatggacgaggcccacttcacggacccgagctccatcgcggcccgcgggtacatcagcacccgggtgggcatgggggaggccgccgccatcttcatgaccgcgacgccgcccggctccgtggaggccttcccccagagcaacgccgtcatccaggacgaggagcgcgacatcccggagcggtcctggaacagcgggtacgagtggatcacggacttccccggcaagaccgtgtggttcgtgccctccatcaagagcggcaacgacatcgccaactgcctgcgcaagaacgggaagcgggtcatccagctctcccgcaagaccttcgacaccgagtaccagaagacgaagaacaacgactgggactacgtggtgaccaccgacatcagcgagatgggcgcgaacttccgggccgaccgcgtcatcgacccccggcgctgcctgaagccggtgatcctgaaggacgggcccgagcgggtcatcctcgccggccccatgcccgtgaccgtggcctccgccgcgcagcgccgggggcgcatcggccggaaccacaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtcgagctcatgcggcgcggggacctgccggtgtggctgagctacaaggtggcctccgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgccctgcgcgagttcaaggagttcgcggccggccggcgcagcgtgtccggggacctgatcctcgagatcggcaagctgccccagcacctgacccagcgggcccagaacgccctcgacaacctggtcatgctgcacaacagcgagcagggcgggcgcgcgtaccggcacgccatggaggagctcccggacaccatcgagaccctgatgctgctcgccctgatcgccgtgctgacgggcggggtgaccctcttcttcctgtccggccgcgggctgggcaagaccagcatcggcctcctgtgcgtcatggcctccagcgtgctgctctggatggcgtccgtggagccccactggatcgccgccagcatcatcctggagttcttcctgatggtcctcctgatccccgagcccgaccggcagcgcaccccgcaggacaaccagctggcctacgtggtgatcgggctcctgttcatgatcctgaccgtcgccgcgaacgagatgggcctcctggagacgaccaagaaggacctggggatcggccacgtggccgtggagaaccaccaccacgccgccatgctcgacgtcgacctgcaccccgcctccgcgtggaccctgtacgccgtggccaccacgatcatcacccccatgatgcggcacaccatcgagaacaccacggccaacatcagcctcaccgccatcgcgaaccaggccgccatcctgatggggctggacaagggctggccgatctccaagatggacatcggcgtgcccctcctggccctggggtgctacagccaggtcaaccccctcaccctgaccgcggccgtgctgatgctcgtggcccactacgccatcatcggccccgggctgcaggccaaggcgacgcgcgaggcccagaagcgcaccgccgccggcatcatgaagaacccgaccgtcgacgggatcgtggccatcgacctggaccccgtggtctacgacgcgaagttcgagaagcagctcggccagatcatgctgctgatcctctgcacctcccagatcctgctgatgcggacgacctgggccctctgcgagagcatcaccctggccaccggccccctgacgaccctctgggaggggtcccccggcaagttctggaacaccaccatcgccgtgagcatggccaacatcttccgcgggagctacctggcgggcgccggcctggccttctccctcatgaagtccctcgggggcgggcggcgcgggacgggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagaccacgaagcacgccgtctcccggggcaccgccaagctccgctggttcgtggagcggaacctggtgaagccggaggggaaggtcatcgacctgggctgcggccgcgggggctggagctactactgcgccgggctgaagaaggtgaccgaggtgaagggctacaccaagggcgggcccggccacgaggagcccatccccatggccacgtacgggtggaacctcgtcaagctgcactccggcaaggacgtgttcttcatcccgcccgagaagtgcgacaccctgctctgcgacatcggggagagctcccccaaccccaccatcgaggagggccggaccctgcgcgtgctgaagatggtcgagccgtggctccgggggaaccagttctgcatcaagatcctgaacccctacatgcccagcgtggtggagacgctggagcagatgcagcgcaagcacggcggcatgctcgtccggaaccccctgtcccgcaacagcacccacgagatgtactgggtgtcctgcgggaccggcaacatcgtgagcgcggtcaacatgacctcccggatgctgctcaaccgcttcaccatggcccaccgcaagccgacgtacgagcgggacgtggacctgggggccggcacccgccacgtggccgtcgagcccgaggtggccaacctggacatcatcggccagcggatcgagaacatcaagcacgagcacaagagcacctggcactacgacgaggacaacccctacaagacctgggcgtaccacgggtcctacgaggtcaagcccagcggcagcgcctccagcatggtgaacggggtggtcaagctcctgacgaagccgtgggacgtgatccccatggtgacccagatcgccatgaccgacaccacgcccttcggccagcagcgcgtcttcaaggagaaggtggacacccggacccccaaggccaagcgcgggaccgcccagatcatggaggtgacggcgaagtggctgtggggcttcctctcccggaacaagaagccgcgcatctgcacccgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtcgagggcgaggggctgcacaagctcggctacatcctgcgggacatcagcaagatccccgggggcaacatgtacgccgacgacacggccggctgggacacccgcatcaccgaggacgacctgcagaacgaggccaagatcaccgacatcatggagcccgagcacgcgctcctggccaagtccatcttcaagctgacgtaccagaacaaggtggtgcgggtccagcgcccggccaagaacgggaccgtgatggacgtgatcagccgccgggaccagcgcggctccgggcaggtcggcacctacggcctcaacaccttcacgaacatggaggcccagctgatccggcagatggagagcgaggggatcttctcccccagcgagctggagacccccaacctcgccggccgcgtgctggactggctggagaagcacggggtggagcggctcaagcgcatggcgatctccggcgacgactgcgtcgtgaagcccatcgacgaccggttcgccaccgccctgaccgccctgaacgacatggggaaggtgcgcaaggacatcccgcagtgggagcccagcaagggctggaacgactggcagcaggtccccttctgcagccaccacttccaccagctcatcatgaaggacggccgggagatcgtggtgccctgccgcaaccaggacgagctggtcgggcgggcccgcgtgtcccagggcgcggggtggagcctgcgggagacggcctgcctcggcaagtcctacgcccagatgtggcagctgatgtacttccaccgccgggacctgcgcctcgccgcgaacgccatctgcagcgccgtgccggtcgactgggtgcccacctcccggaccacctggagcatccacgcccaccaccagtggatgacgaccgaggacatgctgtccgtgtggaaccgcgtctggatcgaggagaacccctggatggaggacaagacccacatcagctcctggggcgacgtgccctacctgggcaagcgggaggaccagtggtgcggcagcctcatcgggctgaccgcccgcgcgacgtgggccaccaacatccaggtggccatcaaccaggtccgccggctgctcggcaacgagaactacctggactacatgacctccatgaagcgcttcaagaacgagagcgacccggagggggccctgtggtga

SEQ ID NO: 8797 - RNA, 9879 nt, synthetic construct
  misc_feature 1..9879: note = derived and/or modified CDS sequence (opt1) from DENV-1__EU482535__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcatcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtcgggctcgtgaccctgtacctgggcgtgatggtccaggccgactccgggtgcgtgatcaactggaagggccgggagctcaagtgcgggagcggcatcttcgtgacgaacgaggtccacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtggtcgtgggggacgtggtcggcatcctcgcgcaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagatgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctccgcttcaagggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtcccgcaagatgctgatgaccggcaccctcgccgtgttcctgctgctcatcatggggcagctgacgtggaacgacctgatccggctctgcatcatggtgggcgccaacgcgagcgaccgcatggggatgggcaccacctacctggccctgatggccaccttcaagatgcgcccgatgttcgccgtcgggctcctgttccggcgcctgacgtcccgggaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccaccctgctgagcctcacgttcatcaagaccaccctgtccctgcactacgcctggaagaccatggccatggtgctcagcatcgtctccctgatccccctgtgcctcagcacgacctcccagaagaccacctggctgcccgtgctgctcggcagcctggggtgcaagccgctgacgatgttcctcatcgcggagaacaagatctggggccgcaagtcctggcccctgaacgaggggatcatggccgtgggcgtcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcaccatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacaccatgtggcacgtgacccggggcgccgtcctgatgtaccaggggaagcgcctggagcccagctgggcgtccgtgaagaaggacctcatcagctacggcggcgggtggcggctgcagggctcctggaacacgggggaggaggtgcaggtcatcgccgtggagccccgcaagaaccccaagaacgtgcagaccgcccccggcaccttcaagacccccgagggggaggtcggcgccatcgccctggacttcaagcccggcacgagcgggtcccccatcgtgaaccgggagggcaagatcgtggggctctacggcaacggcgtcgtgaccaccagcgggacctacgtgagcgcgatcgcccaggccaaggcctcccaggagggcccgctgcccgagatcgaggacgaggtcttccgcaagcggaacctgacgatcatggacctccaccccgggagcggcaagacccgccggtacctgccggcgatcgtgcgcgaggccatcaagcggaagctgcgcaccctcatcctggcccccacccgcgtggtcgcctccgagatggccgaggcgctgaaggggatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgccgcgcgcggctacatcagcacccgggtggggatgggcgaggccgccgccatcttcatgaccgccacgccgcccgggtccgtcgaggcgttcccgcagagcaacgccgtgatccaggacgaggagcgcgacatccccgagcggtcctggaacagcggctacgagtggatcaccgacttccccgggaagaccgtgtggttcgtcccctccatcaagagcggcaacgacatcgccaactgcctccgcaagaacggcaagcgggtgatccagctgtcccgcaagaccttcgacacggagtaccagaagaccaagaacaacgactgggactacgtggtcaccaccgacatcagcgagatgggggccaacttccgggcggaccgcgtgatcgacccgcggcgctgcctgaagcccgtgatcctcaaggacggccccgagcgggtcatcctggccgggcccatgccggtgacggtcgcctccgccgcccagcgccggggccgcatcgggcggaaccacaacaaggagggcgaccagtacatctacatgggccagcccctgaacaacgacgaggaccacgcgcactggaccgaggccaagatgctcctggacaacatcaacacccccgaggggatcatccccgccctgttcgagccggagcgcgagaagtccgccgccatcgacggcgagtaccgcctccgcggggaggcgcgcaagaccttcgtggagctgatgcggcgcggcgacctgcccgtgtggctctcctacaaggtcgccagcgaggggttccagtacagcgaccggcgctggtgcttcgacggcgagcggaacaaccaggtgctggaggagaacatcgacgtggagatctggacgaaggagggcgagcgcaagaagctgcggccccgctggctcgacgcccggacctactccgaccccctggccctgcgcgagttcaaggagttcgccgcggggcggcgcagcgtctccggcgacctcatcctggagatcgggaagctgccgcagcacctcacccagcgggcccagaacgccctggacaacctggtgatgctccacaacagcgagcagggcggccgcgcctaccggcacgcgatggaggagctgcccgacaccatcgagacgctgatgctcctggccctgatcgccgtgctcaccgggggcgtcaccctgttcttcctgtccgggcgcggcctcgggaagaccagcatcggcctgctgtgcgtgatggcctccagcgtgctcctgtggatggcctccgtcgagccccactggatcgcggccagcatcatcctggagttcttcctcatggtgctgctgatccccgagccggaccggcagcgcacgccccaggacaaccagctcgcctacgtggtcatcggcctgctgttcatgatcctcacggtggccgccaacgagatggggctgctggagaccaccaagaaggacctcggcatcgggcacgcggccgtggagaaccaccaccacgccaccatgctggacgtcgacctgcaccccgcctccgcctggacgctctacgcggtggccaccaccatcatcaccccgatgatgcggcacacgatcgagaacaccaccgccaacatcagcctgaccgccatcgccaaccaggcggccatcctgatgggcctcgacaaggggtggcccatctccaagatggacatcggcgtgcccctgctggccctcggctgctacagccaggtcaaccccctgacgctgaccgccgcggtgctcatgctggtggcccactacgccatcatcgggccgggcctgcaggccaaggccacccgcgaggcgcagaagcgcaccgccgccgggatcatgaagaaccccacggtcgacggcatcgtggccatcgacctcgaccccgtggtctacgacgccaagttcgagaagcagctggggcagatcatgctgctcatcctgtgcacctcccagatcctgctcatgcggaccacctgggcgctgtgcgagagcatcacgctggccaccggccccctcaccaccctgtgggagggctccccggggaagttctggaacacgaccatcgccgtgagcatggccaacatcttccgcggctcctacctggccggggcgggcctcgccttcagcctgatgaagtccctgggcgggggccggcgcgggaccggcgcccagggggagaccctcggcgagaagtggaagcggcagctgaaccagctgtccaagagcgagttcaacatctacaagcgctccggcatcatggaggtggaccggagcgaggccaaggaggggctcaagcgcggcgagacgacccggcacgcggtctcccgcgggaccgccaagctgcggtggttcgtggagcgcaacctggtgaagcccgagggcaaggtcatcgacctggggtgcggccggggcgggtggagctactactgcgccggcctcaagaaggtgaccgaggtgaaggggtacacgaagggcgggcccggccacgaggagcccatcccgatggccacctacggctggaacctggtcaagctgcactccgggaaggacgtgttcttcacgccgcccgagaagtgcgacaccctcctgtgcgacatcggcgagagctcccccaacccgacgatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacgggggcatgctggtccgcaacccgctgtcccggaacagcacccacgagatgtactgggtgtcctgcggcaccgggaacatcgtgagcgccgtcaacatgacgtcccgcatgctcctgaaccgcttcaccatggcgcaccggaagcccacctacgagaaggacgtggacctgggcgccgggacccgccacgtggccgtcgagcccgaggtggccaacctcgacatcatcggccagcggatcgagaacatcaagcacgagcacaagagcacgtggcactacgacgaggacaacccctacaagacctgggcctaccacggctcctacgaggtgaagccgagcgggtccgcgagcagcatggtcaacggcgtggtcaagctgctgaccaagccctgggacgtgatccccatggtgacccagatcgccatgacggacaccacccccttcgggcagcagcgcgtcttcaaggagaaggtggacacccggacgccgaaggccaagcgcggcaccgtgcagatcatggaggtcaccgcccggtggctctgggggttcctgtcccgcaacaagaagccccggatctgcacccgcgaggagttcacgcggaaggtgcgcagcaacgccgcgatcggcgccgtgttcgtcgacgagaaccagtggaactccgccaaggaggccgtggaggacgagcggttctgggacctggtgaagaaggagcgcgagctccacaagcagggcaagtgcgcgacctgcgtctacaacatgatggggaagcgggagaagaagctgggcgagttcgggaaggccaagggcagccgcgccatctggtacatgtggctgggggcccggttcctcgagttcgaggccctgggcttcatgaacgaggaccactggttctcccgcgagaacagcctgtccggcgtggagggggagggcctccacaagctggggtacatcctgcgggacatcagcaagatccccggcgggaacatgtacgcggacgacaccgccggctgggacacccgcatcacggaggacgacctccagaacgaggccaagatcaccgacatcatggagccggagcacgccctgctggccacctccatcttcaagctcacctaccagaacaaggtggtccgggtgcagcgccccgcgaagaacggcacggtgatggacgtcatcagccgccgggaccagcgcgggtccggccaggtggggacctacggcctgaacaccttcaccaacatggaggcccagctgatccggcagatggagagcgagggcatcttcctcccctccgagctggagacgcccaacctggccgagcgcgtgctcgactggctggagaagtacggggtcgagcggctgaagcgcatggccatcagcggcgacgactgcgtggtgaagccgatcgacgaccggttcgccaccgcgctcaccgccctgaacgacatggggaaggtccgcaaggacatcccccagtgggagccctccaagggctggaacgactggcagcaggtccccttctgcagccaccacttccaccagctgatcatgaaggacgggcgggagatcgtggtcccgtgccgcaaccaggacgagctcgtgggccgggcccgcgtgtcccagggcgccgggtggagcctgcgggagaccgcctgcctgggcaagagctacgcgcagatgtggcagctcatgtacttccaccgccgggacctgcgcctggccgccaacgccatctgctccgcggtccccgtgaactgggtgcccacgagccggaccacctggtccatccacgcccaccaccagtggatgaccacggaggacatgctcagcgtctggaaccgcgtgtggatcgaggagaacccctggatggaggacaagacccacgtgtccagctggggcgacgtcccgtacctgggcaagcgggaggaccagtggtgcgggtccctgatcggcctcaccgcccgcgccacctgggccagcaacatccaggtggcgatcaaccaggtgcgccggctgatcggcaacgagaactacctggactacatgacctccatgaagcgcttcaagaacgagggggaccccgagggcgccctctggtga

SEQ ID NO: 8798 - RNA, 9879 nt, synthetic construct
  misc_feature 1..9879: note = derived and/or modified CDS sequence (opt1) from DENV-1__EU482536__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacacgatgacctacaagtgcccccggatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccgccacccgcctggagaacatcatgtggaagcagatcagcaacgagctgaaccacatcctcctggagaacgacatgaagctgaccgtggtggtcggggacgtggcgggcatcctcgcccaggggaagaagatgatccggccccagcccatggagtacaagtactcctggaagtcctggggcaaggccaagatcatcggcgccgacgtgcagaacaccacgttcatcatcgacgggcccaacaccccggagtgccccgacgaccagcgcgcgtggaacatctgggaggtcgaggactacggcttcgggatcttcaccaccaacatctggctgaagctgcgggactcctacacccaggtgtgcgaccaccgcctcatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctgtggtccaacggcgtgctcgagagcgagatgatcatccccaagatctacgggggcccgatctcccagcacaactaccgccccgggtacttcacgcagaccgccggcccctggcacctggggaagctggagctcgacttcgacctgtgcgagggcaccaccgtggtcgtggacgagcactgcggcaaccgggggccgagcctgcgcacgaccaccgtgaccggcaagatcatccacgagtggtgctgccggtcctgcacgctgccgcccctccgcttcaagggggaggacggctgctggtacgggatggagatccggcccgtcaaggagaaggaggagaacctggtcaagagcatggtgagcgccggctccggcgaggtcgacagcttctccctcgggctgctgtgcatcagcatcatgatcgaggaggtgatgcgctcccggtggagccgcaagatgctcatgaccggcaccctggccgtgttcttcctgctcatcatggggcagctgacctggaacgacctgatccggctctgcatcatggtcggcgcgaacgcctccgaccgcatggggatgggcacgacctacctggccctgatggccaccttcaagatgcgcccgatgttcgccgtgggcctcctgttccggcgcctgaccagccgggaggtgctcctgctgacgatcgggctctccctggtcgcgagcgtggagctgcccaactccctcgaggagctgggcgacgggctggccatgggcatcatgatcctcaagctgctgaccgacttccagagccaccagctctgggccaccctgctgtccctcaccttcatccgcacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacatgctgaccatcctcctgaaggccaccctgctcgccgtgagcggcgtgtacccgctgtccatccccgccaccctgttcgtctggtacttctggcagaagaagaagcagcggagcggggtgctctgggacacccccagcccgcccgaggtggagcgcgccgtcctggacgacggcatctaccggatcatgcagcgcggcctgctggggcggagccaggtgggcgtgggggtcttccaggagaacgtgttccacacgatgtggcacgtgacccgcggcgcggtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagaccgcccccgggacgttcaagacctccgagggcgaggtcggcgccatcgcgctggacttcaagcccgggaccagcggcagccccatcgtgaaccgggaggggaagatcgtgggcctgtacggcaacggggtcgtgaccacgtccggcacctacgtgagcgccatcgcccaggccaaggcgtcccaggaggggcccctcccggagatcgaggacgaggtcttccgcaagcggaacctgaccatcatggacctgcaccccggcagcgggaagacccgccggtacctccccgccatcgtgcgcgaggccatcaagcggcgcctgcgcacgctgatcctcgccccgacccgggtggtcgcctccgagatggcggaggccctgaagggcatgcccatccgctaccagaccaccgccgtcaagagcgagcacacgggcaaggagatcgtggacctgatgtgccacgccaccttcaccatgcggctcctgtcccccgtccgcgtgcccaactacaacatgatcatcatggacgaggcccacttcaccgacccgagctccatcgcggcccgggggtacatcagcacgcgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcaccgacttccccggcaagacggtgtggttcgtcccctccatcaagagcggcaacgacatcgccaactgcctgcggaagaacgggaagcgcgtgatccagctctcccggaagaccttcgacaccgagtaccagaagaccaagaacaacgactgggactacgtggtcacgaccgacatcagcgagatgggcgcgaacttccgcgccgaccgggtgatcgacccccgccggtgcctgaagccggtgatcctgaaggacgggcccgagcgcgtcatcctcgccggccccatgcccgtgaccgtcgcctccgccgcgcagcggcgcgggcggatcggccgcaaccacaacaaggagggcgaccagtacatctacatggggcagccgctgaacaacgacgaggaccacgcccactggaccgaggccaagatgctgctcgacaacatcaacacgcccgagggcatcatccccgccctgttcgagcccgagcgcgagaagtccgccgcgatcgacggggagtaccggctgcgcggcgaggcccggaagaccttcgtggagctcatgcgccgcggggacctgccggtgtggctgagctacaaggtcgcctccgagggcttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccccagcacctgacgcagcgcgcccagaacgccctcgacaacctggtgatgctgcacaacagcgagcagggcgggcgggcgtaccgccacgccatggaggagctcccggacaccatcgagaccctgatgctgctcgccctgatcgccgtgctgaccggcggggtcacgctgttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagcccgaccgccagcggaccccgcaggacaaccagctggcctacgtggtcatcgggctcctgttcatgatcctgaccgtggccgcgaacgagatgggcctcctggagaccacgaagaaggacctggggatcggccacgtggccgtcgagaaccaccaccacgccgccatgctcgacgtggacctgcaccccgcctccgcgtggaccctgtacgccgtggccaccaccatcatcacgcccatgatgcgccacaccatcgagaacaccaccgccaacatcagcctcacggccatcgcgaaccaggccgccatcctgatggggctggacaagggctggccgatctccaagatggacatcggcgtccccctcctggccctggggtgctacagccaggtgaaccccctcaccctgaccgcggccgtgctgatgctcgtcgcccactacgccatcatcggccccgggctgcaggccaaggcgacccgcgaggcccagaagcggacggccgccggcatcatgaagaacccgaccgtggacgggatcgtggccatcgacctggaccccgtcgtgtacgacgcgaagttcgagaagcagctcggccagatcatgctgctgatcctctgcacctcccagatcctgctgatgcgcaccacgtgggccctctgcgagagcatcaccctggccaccggccccctgaccacgctctgggaggggtcccccggcaagttctggaacaccaccatcgccgtgagcatggccaacatcttccgggggagctacctggcgggcgccggcctggccttctccctcatgaagtccctcgggggcgggcgccgggggaccggggcccagggcgagacgctgggcgagaagtggaagcgccagctcaaccagctgtccaagagcgagttcaacacctacaagcggtccgggatcatggaggtcgaccgcagcgaggcgaaggagggcctgaagcgcggggagaccaccaagcacgccgtgtcccgcggcacggccaagctccggtggttcgtggagcgcaacctggtcaagccggaggggaaggtgatcgacctgggctgcggccgcggcgggtggagctactactgcgccgggctgaagaaggtgaccgaggtcaaggggtacaccaagggcgggcccggccacgaggagcccatccccatggccacctacgggtggaacctcgtgaagctgcactccggcaaggacgtgttcttcatcccgcccgagaagtgcgacacgctgctctgcgacatcggggagagctcccccaaccccaccatcgaggagggccgcaccctgcgggtcctgaagatggtggagccgtggctccgcgggaaccagttctgcatcaagatcctgaacccctacatgcccagcgtggtcgagaccctggagcagatgcagcggaagcacggcggcatgctcgtgcgcaaccccctgtcccggaacagcacgcacgagatgtactgggtgtcctgcgggaccggcaacatcgtcagcgcggtgaacatgacctcccgcatgctgctcaaccgcttcaccatggcccaccggaagccgacctacgagcgcgacgtggacctgggggccggcacgcggcacgtcgccgtggagcccgaggtggccaacctggacatcatcggccagcgcatcgagaacatcaagcacgagcacaagagcacctggcactacgacgaggacaacccctacaagacctgggcgtaccacgggtcctacgaggtcaagcccagcggcagcgcctccagcatggtgaacggggtcgtgaagctcctgaccaagccgtgggacgtgatccccatggtcacgcagatcgccatgaccgacaccacccccttcggccagcagcgggtgttcaaggagaaggtggacacgcgcacccccaaggccaagcgggggaccgcccagatcatggaggtcaccgcgaagtggctgtggggcttcctctcccgcaacaagaagccgcggatctgcacgcgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacgcggatcaccgaggacgacctgcagaacgaggccaagatcaccgacatcatggagcccgagcacgcgctcctggccaagtccatcttcaagctgacctaccagaacaaggtggtccgcgtgcagcgcccggccaagaacgggacggtgatggacgtcatcagccggcgcgaccagcggggctccggccaggtgggcacctacggcctcaacaccttcaccaacatggaggcccagctgatccgccagatggagagcgaggggatcttctcccccagcgagctggagacgcccaacctcgccggccgggtgctggactggctggagaagcacggggtcgagcgcctcaagcggatggcgatctccggcgacgactgcgtggtgaagcccatcgacgaccgcttcgccaccgccctgaccgccctgaacgacatggggaaggtccggaaggacatcccgcagtgggagcccagcaagggctggaacgactggcagcaggtccccttctgcagccaccacttccaccagctcatcatgaaggacggccgcgagatcgtggtcccctgccggaaccaggacgagctggtggggcgcgcccgggtgtcccagggcgcggggtggagcctgcgcgagaccgcctgcctcggcaagtcctacgcccagatgtggcagctgatgtacttccaccggcgcgacctgcggctcgccgcgaacgccatctgcagcgccgtcccggtggactgggtgcccacgtcccgcaccacctggagcatccacgcccaccaccagtggatgaccacggaggacatgctgtccgtctggaaccgggtgtggatcgaggagaacccctggatggaggacaagacccacgtgagctcctggggcgacgtcccctacctgggcaagcgcgaggaccagtggtgcggcagcctcatcgggctgaccgcccgcgcgacctgggccacgaacatccaggtggccatcaaccaggtgcggcgcctgctcggcaacgagaactacctggactacatgacctccatgaagcggttcaagaacgagagcgacccggagggggccctgtggtga

SEQ ID NO: 8799 - RNA, 9879 nt, synthetic construct
  misc_feature 1..9879: note = derived and/or modified CDS sequence (opt1) from DENV-1__EU482537__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggagcgtggccctcgcgccccacgtgggcctggggctggagacccgcaccgagacctggatgtccagcgagggcgcctggaagcagatccagcgggtcgagacgtgggccctccgccaccccgggttcaccgtgatcgccctgttcctggcgcacgccatcggcacctccatcacccagaaggggatcatcttcatcctcctgatgctggtgacgcccagcatggccatgcggtgcgtcggcatcggctcccgcgacttcgtggaggggctcagcggcgccacctgggtggacgtcgtgctggagcacgggtcctgcgtgaccaccatggccaaggacaagcccacgctggacatcgagctcctgaagaccgaggtcaccaaccccgcggtgctgcggaagctctgcatcgaggccaagatcagcaacaccacgaccgactcccgctgccccacccagggcgaggccaccctgatggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcatccagaacggccggctgatcacggccaacccgatcgtgaccgacaaggagaagcccgtgaacatcgaggccgagccgcccttcggggagtcctacatcgtcatcggcgtgggcgagaaggcgctgaagctcagctggttcaagaaggggtccagcatcggcaagatgttcgaggccaccgcccgcggggcccggcgcatggccatcctgggcgacaccgcgtgggacttcgggtccatcggcggcgtgttcacgagcgtcgggaagctggtgcaccagatcttcggcaccgcctacggggtcctgttctccggcgtcagctggaccatgaagatcgggatcggcgtgctgctgacctggctcggcctgaactcccgcagcacgtccctgagcatgacctgcatcgccgtggggctcgtcaccctgtacctgggcgtgatggtgcaggccgactccgggtgcgtcatcaactggaagggccgggagctcaagtgcgggagcggcatcttcgtgaccaacgaggtgcacacgtggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggtgggcatcctcgcccaggggaagaagatgatccggccccagcccatggagcacaagtacagctggaagtcctggggcaaggcgaagatcatcggcgccgacgtccagaacaccacgttcatcatcgacgggcccaacaccccggagtgccccgacgaccagcgcgcctggaacatctgggaggtggaggactacggcttcgggatcttcaccaccaacatctggctgaagctgcgggacagctacacgcaggcctgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacaccctgtggagcaacggcgtgctcgagtccgagatggtgatccccaagatctacgggggcccgatcagccagcacaactaccgccccgggtacttcacgcagaccgccggcccctggcacctggggaagctggagctcgacttcgacctgtgcgagggcaccaccgtcgtggtggacgagcactgcggcaaccgggggccgtccctgcgcacgaccaccgtcaccggcaagatcatccacgagtggtgctgccggagctgcacgctgccgcccctccgcttcaagggggaggacggctgctggtacgggatggagatccggcccgtgaaggagaaggaggagaacctggtgaagtccatggtcagcgccggcagcggcgaggtggactccttcagcctcgggctgctgtgcatctccatcatgatcgaggaggtgatgcgcagccggtggtcccgcaagatgctcatgaccggcaccctggccgtcttcctgctcctgatcatggggcagctgacctggaacgacctcatccggctgtgcatcatggtgggcgccaacgcgagcgaccgcatggggatgggcacgacctacctggccctcatggccaccttcaagatgcgcccgatgttcgccgtggggctgctgttccggcgcctcacctcccgggaggtcctgctgctcacgatcgggctgagcctggtggcctccgtcgagctccccaacagcctggaggagctgggcgacgggctcgcgatgggcatcatgatcctgaagctgctcaccgacttccagtcccaccagctgtgggccaccctgctcagcctgaccttcatcaagacgaccctgtccctccactacgcctggaagaccatggccatggtgctgagcatcgtgtccctgttccccctctgcctgagcaccacgtcccagaagaccacctggctgcccgtcctcctgggcagcctggggtgcaagccgctcaccatgttcctgatcgcggagaacaagatctggggccgcaagtcctggcccctgaacgaggggatcatggccgtgggcgtggtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggacgatgaagatcaaggacgaggagcgggacgacaccctgaccatcctgctcaaggcgaccctgctggccgtctccggcgtgtacccgctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagacccccgagggcgaggtgggcgccatcgccctcgacttcaagcccgggaccagcggctcccccatcgtcaaccgcgaggggaagatcgtgggcctgtacggcaacggggtggtcacgaccagcggcacctacgtgagcgcgatcgcccaggccaaggcctcccaggaggggccgctgcccgagatcgaggacgaggtgttccggaagcgcaacctcaccatcatggacctgcaccccggcagcgggaagacgcggcgctacctgccggcgatcgtccgggaggccatcaagcgcaagctccggaccctgatcctggcccccacccgcgtggtggcctccgagatggccgaggcgctcaagggcatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccgcagagcaacgccgtcatccaggacgaggagcgggacatccccgagcgctcctggaacagcgggtacgagtggatcacggacttccccggcaagaccgtgtggttcgtgccctccatcaagagcggcaacgacatcgccaactgcctgcggaagaacgggaagcgcgtcatccagctgtcccggaagaccttcgacaccgagtaccagaagacgaagaacaacgactgggactacgtggtgaccaccgacatcagcgagatgggcgccaacttccgcgcggaccgggtcatcgacccgcgccggtgcctcaagcccgtgatcctgaaggacgggcccgagcgcgtcatcctggccggccccatgccggtgaccgtggcctccgccgcccagcggcgcgggcggatcggccgcaaccacaacaaggagggcgaccagtacatctacatggggcagcccctcaacaacgacgaggaccacgcgcactggacggaggccaagatgctgctggacaacatcaacacccccgagggcatcatccccgccctcttcgagccggagcgggagaagtccgccgccatcgacggggagtaccgcctgcgcggcgaggcgcggaagaccttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacgtactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacaccatcgagaccctcatgctgctggccctcatcgccgtgctgacgggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctcttcatgatcctgaccgtcgccgccaacgagatgggcctgctcgagacgaccaagaaggacctggggatcggccacgtggcggtggagaaccaccaccacgccaccatgctggacgtcgacctccaccccgcctccgcctggaccctgtacgccgtggcgacgaccatcatcaccccgatgatgcgccacaccatcgagaacacgaccgccaacatcagcctgaccgccatcgccaaccaggccgcgatcctcatggggctggacaagggctggcccatctccaagatggacatcggcgtgcccctgctcgccctggggtgctacagccaggtcaaccccctgaccctcacggccgccgtgctgatgctggtggcgcactacgccatcatcggcccggggctccaggccaaggccacccgggaggcccagaagcgcaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggccccctgaccaccctgtgggaggggtccccgggcaagttctggaacaccacgatcgccgtgagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacatctacaagcggtccgggatcatggaggtggaccgcagcgaggccaaggagggcctgaagcgcggggagaccacgcgccacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagcccatcccgatggccacgtacgggtggaacctggtcaagctccactccggcaaggacgtgttcttcacgccgcccgagaagtgcgacaccctgctgtgcgacatcggggagagctcccccaacccgaccatcgaggagggccggacgctccgcgtgctgaagatggtcgagccctggctgcgggggaaccagttctgcatcaagatcctcaacccctacatgcccagcgtggtggagaccctggagcagatgcagcgcaagcacggcggcatgctggtccggaacccgctctcccgcaacagcacccacgagatgtactgggtgtcctgcgggaccggcaacatcgtgagcgccgtcaacatgacctcccggatgctgctgaaccgcttcacgatggcccaccgcaagcccacctacgagcgggacgtggacctcggggcgggcacccgccacgtggccgtcgagcccgaggtggccaacctggacatcatcggccagcggatcgagaacatcaagcacgagcacaagagcacctggcactacgacgaggacaacccctacaagacgtgggcctaccacgggtcctacgaggtcaagccgagcggctccgccagcagcatggtgaacggggtggtcaagctgctcaccaagccctgggacgtgatccccatggtgacccagatcgcgatgaccgacacgacccccttcggccagcagcgcgtcttcaaggagaaggtggacacccggaccccgaaggccaagcgcgggacggcccagatcatggaggtgaccgcccggtggctgtggggcttcctgtcccgcaacaagaagccccggatctgcacccgcgaggagttcacccggaaggtccgcagcaacgccgcgatcggcgccgtgttcgtggacgagaaccagtggaactccgccaaggaggccgtcgaggacgagcggttctgggacctcgtgcagaaggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccgggggcaacatgtacgcggacgacaccgccggctgggacacccgcatcaccgaggacgacctgcagaacgaggccaagatcacggacatcatggagccggagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggcccagctcatccggcagatggagagcgaggggatcttcctgccctccgagctggagacccccaacctcgccgagcgcgtgctggactggctggagaagcacggcgtggagcggctcaagcgcatggccatcagcggggacgactgcgtcgtgaagccgatcgacgaccggttcgccacggcgctgaccgccctgaacgacatgggcaaggtgcgcaaggacatcccccagtgggagccctccaaggggtggaacgactggcagcaggtccccttctgcagccaccacttccaccagctcatcatgaaggacggccgggagatcgtggtgccgtgccgcaaccaggacgagctggtcggccgggcccgcgtgtcccagggggccggctggagcctgcgggagaccgcctgcctcggcaagagctacgcgcagatgtggcagctgatgtacttccaccgccgggacctgcgcctcgccgccaacgccatctgctccgcggtgcccgtcgactgggtgcccaccagccggacgacctggtccatccacgcccaccaccagtggatgaccaccgaggacatgctgagcgtgtggaaccgcgtctggatcgaggagaacccctggatggaggacaagacgcacgtgtccagctggggcgacgtgccgtacctggggaagcgggaggaccagtggtgcggctccctcatcggcctgaccgcccgcgccacctgggccagcaacatccaggtcgcgatcaaccaggtgcgccggctgatcgggaacgagaactacctcgactacatgacctccatgaagcgcttcaagaacgagggcgaccccgagggggccctgtggtga

SEQ ID NO: 8800 - RNA, 9879 nt, synthetic construct
  misc_feature 1..9879: note = derived and/or modified CDS sequence (opt1) from DENV-1__EU482538__SS-prME
  source 1..9879: mol_type = other RNA
agcgtgaccatgctgctgatgctgatgcccaccgccctggccttccacctcaccacccgcggcggggagccgcacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccacccggggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgaccgcgagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccgccgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccggtccacgagcctgtccatgacctgcatcgccgtggggctggtcaccctctacctgggcgtgatggtgcaggccgacagcgggtgcgtcatcaactggaagggccgcgagctgaagtgcgggagcggcatcttcgtgaccaacgaggtgcacacgtggaccgagcagtacaagttccaggcggactccccgaagcggctcagcgccgccatcggcaaggcctgggaggagggggtctgcggcatccgctccgccacccggctggagaacatcatgtggaagcagatcagcaacgagctgaaccacatcctcctggagaacgacatgaagctgaccgtggtggtcggggacgtggcgggcatcctcgcccaggggaagaagatgatccgcccccagcccatggagtacaagtactcctggaagtcctggggcaaggccaagatcatcggcgccgacgtgcagaacaccacgttcatcatcgacgggcccaacaccctggagtgcccggacgaccagcgggcgtggaacatctgggaggtcgaggactacggcttcgggatcttcaccaccaacatctggctgaagctccgcgacagctacacccaggtgtgcgaccaccggctgatgagcgccgccatcaaggactccaaggccgtgcacgccgacatgggctactggatcgagagcgagaagaacgagacctggaagctggcgcgcgcctccttcatcgaggtcaagacctgcatctggcccaagagccacaccctctggtccaacggcgtgctggagagcgagatgatcatccccaagatctacgggggccccatctcccagcacaactaccggccggggtacttcacgcagaccgccggcccctggcacctggggaagctcgagctggacttcgacctgtgcgagggcaccaccgtggtcgtggacgagcactgcggcaaccgcgggcccagcctccggacgaccaccgtgaccggcaagatcatccacgagtggtgctgccgctcctgcacgctgccgcccctgcggttcaagggggaggacggctgctggtacgggatggagatccgccccgtcaaggagaaggaggagaacctcgtgaagtccatggtgagcgccggctccggcgaggtcgacagcttctccctggggctgctctgcatcagcatcatgatcgaggaggtgatgcggtcccgctggagccggaagatgctgatgaccggcaccctggccgtgttcttcctcctgatcatggggcagctgacctggaacgacctcatccgcctgtgcatcatggtcggcgcgaacgcctccgaccgcatggggatgggcacgacctacctggccctcatggccaccttcaagatgcggcccatgttcgccgtgggcctgctgttccgccggctcaccagccgcgaggtgctgctgctcacgatcgggctgtccctggtcgcgagcgtggagctcccgaactccctggaggagctgggcgacgggctcgccatgggcatcatgatcctgaagctgctcaccgacttccagagccaccagctgtgggccaccctgctctccctgaccttcatccggacgaccttcagcctgcactacgcctggaagaccatggcgatggtcctctccatcgtgagcctgttccccctgtgcctctccaccacgagccagaagaccacctggctgcccgtgctgctcggctccctggggtgcaagcccctgaccatgttcctcatcgccgagaacaagatctggggccgcaagagctggccgctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtaccccctgtccatcccggccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccgtcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacctccgagggcgaggtcggcgccatcgcgctggacttcaagccggggaccagcggcagccccatcgtgaaccgcgaggggaagatcgtgggcctctacggcaacggggtcgtgacgacctccggcacctacgtgagcgccatcgcccagaccaaggcctcccaggaggggcccctgcccgagatcgaggacgaggtcttccggaagcgcaacctgacgatcatggacctccacccgggcagcgggaagacccggcgctacctgcccgcgatcgtgcgggaggccatcaagcgccgcctgcggaccctcatcctggcccccacccgcgtggtcgcctccgagatggccgaggcgctgaagggcatgccgatccggtaccagacgaccgccgtcaagagcgagcacaccggcaaggagatcgtggacctcatgtgccacgccaccttcacgatgcgcctgctgtcccccgtccgggtgcccaactacaacatgatcatcatggacgaggcccacttcaccgaccccagctccatcgccgcgcgcgggtacatcagcacccgggtgggcatgggggaggccgccgccatcttcatgaccgccacgccgcccggctccgtcgaggcgttcccccagagcaacgccgtgatccaggacgaggagcgcgacatccccgagcggtcctggaacagcgggtacgagtggatcaccgacttcccgggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgccaacttccgggcggaccgcgtgatcgacccccggcgctgcctgaagcccgtgatcctcaaggacgggccggagcgggtcatcctggccggccccatgcccgtgacggtcgcctccgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacaccccggagggcatcatccccgccctgttcgagcccgagcgggagaagtccgccgccatcgacggggagtaccgcctccggggcgaggcgcgcaagaccttcgtggagctgatgcggcgcggggacctgcccgtgtggctcagctacaaggtcgcctccgagggcttccagtacagcgaccggcgctggtgcttcgacggcgagcggaacaaccaggtgctggaggagaacatggacgtggagatctggacgaaggagggggagcgcaagaagctgcggccgcgctggctcgacgcccggacctactccgaccccctggccctgcgcgagttcaaggagttcgccgcgggccggcgcagcgtctccggggacctcatcctggagatcggcaagctgccccagcacctcacccagcgggcccagaacgccctggacaacctggtgatgctccacaacagcgagcagggcgggcgcgcctaccggcacgcgatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcctccgtcgagccgcactggatcgcggccagcatcatcctggagttcttcctcatggtgctgctgatccccgagcccgaccggcagcgcacgccccaggacaaccagctcgcctacgtggtcatcgggctgctgttcatgatcctcacggtggccgccaacgagatgggcctgctggagaccaccaagaaggacctcgggatcggccacgtggcggtcgagaaccaccaccacgccgccatgctggacgtggacctgcacccggcctccgcctggaccctctacgcggtggccacgaccatcatcacccccatgatgcgccacaccatcgagaacacgaccgccaacatcagcctgaccgccatcgccaaccaggcggccatcctgatggggctcgacaagggctggcccatctccaagatggacatcggcgtcccgctgctggccctcgggtgctacagccaggtgaaccccctgaccctgacggccgcggtgctcatgctggtcgcccactacgccatcatcggccccgggctgcaggccaaggccacccgggaggcgcagaagcgcaccgccgccggcatcatgaagaaccccaccgtggacgggatcgtggccatcgacctcgacccggtcgtgtacgacgccaagttcgagaagcagctgggccagatcatgctgctcatcctgtgcacgtcccagatcctgctcatgcggaccacctgggcgctgtgcgagagcatcaccctggccacgggccccctcaccaccctgtgggaggggtcccccggcaagttctggaacaccacgatcgccgtgagcatggccaacatcttccgcgggagctacctggccggcgcgggcctcgccttctccctgatgaagtccctcgggggcgggcggcgcgggaccggggcccagggcgagaccctcggcgagaagtggaagcggcagctgaaccagctgtccaagagcgagttcaacacctacaagcgctccgggatcatggaggtcgaccggagcgaggccaaggagggcctcaagcgcggggagacgaccaagcacgcggtgtcccggggcaccgccaagctgcgctggttcgtggaccggaacctggtcaagcccgaggggaaggtgatcgacctgggctgcggccgcgggggctggagctactactgcgccgggctcaagaaggtgaccgaggtcaagggctacacgaagggcgggccgggccacgaggagcccatccccatggccacctacgggtggaacctggtgaagctgcactccggcaaggacgtgttcttcatcccgcccgagaagtgcgacaccctcctgtgcgacatcggggagagctcccccaaccccaccatcgaggagggccggacgctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaaccccctgtcccgcaacagcacccacgagatgtactgggtgtcctgcgggaccggcaacatcgtcagcgccgtgaacatgacctcccgcatgctcctgaaccggttcacgatggcgcaccgcaagcccacctacgagcgggacgtggacctgggggccggcacccgccacgtcgccgtggagccggaggtggccaacctcgacatcatcggccagcggatcgagaacatcaagcacgagcacaagagcacctggcactacgacgaggacaacccctacaagacgtgggcctaccacgggtcctacgaggtcaagcccagcggcagcgcgtccagcatggtgaacggggtcgtgaagctgctgaccaagccctgggacgtgatcccgatggtcacccagatcgccatgaccgacacgacccccttcggccagcagcgcgtgttcaaggagaaggtggacacccggacccccaaggccaagcgcgggacggcccagatcatggaggtcaccgccaagtggctctggggcttcctgtcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctccacaagcaggggaagtgcgccacgtgcgtctacaacatgatgggcaagcgggagaagaagctgggggagttcggcaaggccaaggggagccgcgccatctggtacatgtggctgggcgcccggttcctcgagttcgaggcgctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctccagaacgaggccaagatcacggacatcatggagcccgagcacgccctgctggcgaagtccatcttcaagctcacctaccagaacaaggtggtccgcgtgcagcggcccgccaagaacgggaccgtgatggacgtcatcagccgccgggaccagcgcggctccggccaggtgggcacctacggcctgaacacgttcaccaacatggaggcccagctgatccggcagatggagagcgaggggatcttctccccgagcgagctcgagacccccaacctggccggccgcgtgctggactggctcgagaagcacggggtcgagcggctgaagcgcatggccatctccggcgacgactgcgtggtgaagcccatcgacgaccggttcgcgaccgccctgacggccctcaacgacatggggaaggtccgcaaggacatcccccagtgggagccgagcaagggctggaacgactggcagcaggtccccttctgcagccaccacttccaccagctgatcatgaaggacggccgggagatcgtggtcccctgccgcaaccaggacgagctggtggggcgggcccgcgtgtcccagggcgccgggtggagcctccgggagaccgcgtgcctgggcaagtcctacgcccagatgtggcagctgatgtacttccaccgccgggacctccgcctggccgccaacgcgatctgcagcgccgtccccgtggactgggtgccgacctcccggaccacgtggagcatccacgcccaccaccagtggatgaccaccgaggacatgctgtccgtctggaaccgcgtgtggatcgaggagaacccctggatggaggacaagacccacgtgagctcctgggaggacgtcccctacctcgggaagcgcgaggaccagtggtgcggcagcctgatcggcctgacggcccgggccacctgggcgaccaacatccaggtggccatcaaccaggtgcgccggctcctggggaacgagaactacctggactacatgacctccatgaagcgcttcaagaacgagagcgaccccgagggcgccctctggtga

SEQ ID NO: 8801 - RNA, 9879 nt, synthetic construct
  misc_feature 1..9879: note = derived and/or modified CDS sequence (opt1) from DENV-1__EU482539__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcaccctgcagatcctgctcatgcgcaccacctgggcgctgtgcgagtccatcacgctggccaccgggcccctcaccaccctgtgggagggcagcccggggaagttctggaacacgaccatcgccgtgtccatggccaacatcttccggggcagctacctggccggcgcggggctcgccttctccctgatgaagtccctgggcgggggccgccgggggaccggcgcccagggcgagaccctcggggagaagtggaagcgccagctgaaccagctgagcaagtccgagttcaacacgtacaagcggagcggcatcatggaggtcgaccgctccgaggccaaggaggggctcaagcggggcgagaccaccaagcacgcggtgagccgcgggaccgccaagctgcggtggttcgtggagcgcaacctggtcaagcccgagggcaaggtgatcgacctgggctgcgggcggggcgggtggtcctactactgcgccggcctcaagaaggtgacggaggtcaaggggtacaccaagggcggccccgggcacgaggagcccatcccgatggccacctacggctggaacctggtgaagctgcacagcgggaaggacgtgttcttcatcccgcccgagaagtgcgacaccctcctgtgcgacatcggcgagtccagccccaacccgacgatcgaggaggggcgcaccctgcgggtcctcaagatggtggagccctggctgcgcggcaaccagttctgcatcaagatcctgaacccctacatgccctccgtggtcgagaccctcgagcagatgcagcggaagcacggcgggatgctggtgcgcaacccgctgagccggaactccacccacgagatgtactgggtgagctgcggcaccgggaacatcgtctccgccgtgaacatgacgagccgcatgctcctgaaccgcttcaccatggcgcaccggaagcccacctacgagcgcgacgtggacctgggcgccggcacccggcacgtcgccgtggagcccgaggtggccaacctcgacatcatcgggcagcgcatcgagaacatcaagcacgagcacaagtccacgtggcactacgacgaggacaacccctacaagacctgggcctaccacggcagctacgaggtcaagccgtccgggagcgcgtccagcatggtgaacggcgtcgtgaagctgctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctctggggcttcctgagccgcaacaagaagccccggatctgcacccgcgaggagttcacgcggaaggtgcgctccaacgcggccatcggggccgtgttcgtcgacgagaaccagtggaacagcgccaaggaggcggtggaggacgagcggttctgggacctggtgcaccgcgagcgggagctccacaagcagggcaagtgcgcgacctgcgtctacaacatgatggggaagcgcgagaagaagctgggcgagttcgggaaggccaagggctcccgggccatctggtacatgtggctgggcgcccgcttcctcgagttcgaggcgctggggttcatgaacgaggaccactggttcagccgggagaactccctgagcggcgtggagggggagggcctccacaagctggggtacatcctgcgcgacatctccaacatccccggcggcaacatgtacgccgacgacaccgccgggtgggacacccggatcacggaggacgacctccagaacgaggcccgcatcaccgacatcatggagccggagcacgccctgctggccaagagcatcttcaagctcacctaccagaacaaggtggtccgcgtgcagcggcccgccaagaacggcaccgtgatggacgtcatctcccgccgggaccagcgcgggagcggccaggtgggcacgtacgggctgaacaccttcaccaacatggaggcccagctgatccggcagatggagtccgagggcatcttcagcccctccgagctcgagacccccaacctggccgagcgcgtgctggactggctcgagaagtacggggtcgagcggctgaagcgcatggccatcagcggcgacgactgcgtggtgaagccgatcgacgaccggttcgcgacggccctgaccgccctcaacgacatggggaaggtccgcaaggacatcccccagtgggagccctccaagggctggaacgactggcagcaggtccccttctgcagccaccacttccaccagctgatcatgaaggacggccgggagatcgtggtcccgtgccgcaaccaggacgagctggtggggcgggcccgcgtgtcccagggcgccgggtggagcctccgggagaccgcgtgcctgggcaagagctacgcccagatgtggcagctgatgtacttccaccgccgggacctccgcctggccgccaacgcgatctgctccgccgtccccgtggactggatccccaccagccggacgacctggtccatccacgcccaccaccagtggatgaccaccgaggacatgctgagcgtgtggaaccgcgtctggatcgaggagaacccctggatggaggacaagacgcacatctccagctggggcgacgtgccgtacctcggcaagcgcgaggaccagtggtgcggctccctgatcgggctgaccgcccgggccacctgggcgaccaacatccaggtggccatcaaccaggtccgccggctcatcggcaacgagaactacctggactacatgaccagcatgaagcgcttcaagaacgagtccgaccccgagggggccctgtggtga

SEQ ID NO: 8802 - RNA, 9879 nt, synthetic construct
  misc_feature 1..9879: note = derived and/or modified CDS sequence (opt1) from DENV-1__KP188539__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacccggaccgagacctggatgagcagcgagggcgcctggaagcagatccagaaggtggagacctgggccctgcggcacccggggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccatcatcacgccccaggcgcccaccagcgagatccagctgacggactacggggccctcaccctggactgcagcccccggaccggcctggacttcaacgagatggtgctcctgaccatgaaggagaagtcctggctggtgcacaagcagtggttcctcgacctgccgctgccctggacgtccggggccagcaccagccaggagacctggaaccgccaggacctcctggtcaccttcaagacggcccacgccaagaagcaggaggtggtggtcctgggctcccaggagggcgcgatgcacaccgccctcaccggggccaccgagatccagacgagcggcaccaccaccatcttcgccgggcacctgaagtgccggctgaagatggacaagctcacgctgaagggcatgtcctacgtgatgtgcaccgggagcttcaagctggagaaggaggtggccgagacccagcacggcaccgtcctggtccaggtgaagtacgagggcacggacgcgccctgcaagatccccttcctcacccaggacgagaagggggtcacccagaacggccgcctgatcaccgccaacccgatcgtgacggacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacaccgcctgggacttcgggtccatcggcggcctgttcacgagcgtggggaagctcatccaccaggtcttcggcaccgcgtacggggtgctgttctccggcgtgagctggaccatgaagatcgggatcggcatcctgctcacctggctgggcctgaactcccgcagcacgtccctcagcatgacctgcatcgccgtcgggatggtgaccctgtacctgggcgtgatggtccaggccgactccgggtgcgtgatcaactggaagggccgcgagctcaagtgcgggagcggcatcttcgtgaccaacgaggtccacacgtggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacaccacgttcatcatcgacgggcccgacaccccggagtgccccgacgaccagcgggcctggaacatctgggaggtcgaggactacggcttcgggatcttcaccaccaacatctggctgaagctgcgcgacagccacacgcagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacaccctgtggagcaacggcgtcctcgagtccgagatggtgatccccaagatctacgggggcccgatcagccagcacaactaccggcccgggtacttcacgcagaccgccggcccctggcacctggggaagctggagctcgacttcgacctgtgcgagggcaccaccgtggtcgtggacgagcactgcggctaccgcgggccgtccctgcggacgaccaccgtgaccggcaagatcatccacgagtggtgctgccgcagctgcacgctgccgcccctgcggttccgcggggaggacggctgctggtacgggatggagatccggcccgtcaaggagaaggaggagaacctggtgcgctccatggtgagcgcgggctccggcgagatggacagcttcagcctcgggatcctgtgcgtctccatcctgatcgaggaggtgatgcggagccgctggtcccggaagatgctcatgaccggcaccctggccgtgttcctgctcctgatcatggggcagctgacctggaacgacctcatccgcctgtgcatcatggtcggcgccaacgccagcgaccgcatggggatgggcacgacctacctggccctcatggcgaccttcaagatgcggccgatgttcgccgtgggcctgctgttccgccggctcacctcccgcgaggtgctgctgctcacggtcgggctgagcctggtggcctccgtcgagctccccaacagcctggaggagctgggcgacgggctcgccatgggcatcatgatgctgaagctgctcaccgacttccagccccaccagctgtggaccaccctgctctccctgacgttcatccggaccagcctgtccctcgactacgcctggaagaccatggcgatggccctgagcatcgtgtccctgttccccctctgcctgagcaccacgtcccagaagaccacctggctgccggtgctcctgggcagcttcgggtgcaagcccctgaccatgttcctcatcacggagaacaagatctggggccgcaagtcctggcccatcaacgaggggatcatggccgtcggcatcgtgagcatcctgctgtccagcctcctgaaggacgacgtgcccctggccgggccgctcatcgcgggcggcatgctgatcgcctgctacgtcatcagcgggtccagcgccgacctgtccctcgagaaggccgccgaggtgagctgggaggaggaggcggagcactccggcaccagccacaacatcctggtggaggtccaggacgacgggaccatgaagatcaaggacgaggagcgggacgacaccctgaccatcctcctgaaggccacgctgctcgccgtgtccggcgtgtaccccatgagcatccccgccaccctgttcgtctggtacttctggcagaagaagaagcagcgctccggggtgctgtgggacacccccagcccgcccgaggtggagcgggccgtcctggacgacggcatctaccgcatcctccagcggggcctgctggggcgctcccaggtgggcgtgggggtcttccaggacggcgtgttccacaccatgtggcacgtgacgcgcggggcggtcctcatgtaccagggcaagcgcctggagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacccccggcacgttcaagacccccgagggcgaggtcggggccatcgccctcgacttcaagcccggcaccagcgggtccccgatcgtgaaccgcgagggcaagatcgtgggcctgtacgggaacggcgtcgtgaccacgagcgggacctacgtgtccgcgatcgcccaggccaaggccacccaggagggccccctgcccgagatcgaggacgaggtcttcaagaagcggaacctcaccatcatggacctgcacccggggagcggcaagacgcgccggtacctgcccgccatcgtgcgcgaggcgatcaagcggaagctccgcaccctgatcctggcccccacccgcgtggtcgccagcgagatggccgaggcgctcaagggcatgcccatccggtaccagaccacggccgtgaagtccgagcacaccgggcgcgagatcgtggacctgatgtgccacgccaccttcaccatgcggctgctcagcccggtccgcgtgcccaactacaacatgatcatcatggacgaggcccacttcacggaccccgcctccatcgcggcccggggctacatcagcacccgcgtggggatgggcgaggccgccgccatcttcatgaccgcgacgccgcccgggtccgtcgaggccttcccccagagcaacgccgtgatccaggacgaggagcgggacatccccgagcgctcctggaacagcggctacgactggatcacggacttccccggcaagaccgtgtggttcgtcccctccatcaagagcgggaacgacatcgccaactgcctgcggaagaacggcaagcgcgtgatccagctgtcccggaagaccttcgacaccgagtaccagaagacgaagaacaacgactgggactacgtggtcaccaccgacatcagcgagatgggggccaacttccgcgcggaccgggtgatcgacccccgccggtgcctcaagcccgtgatcctgaaggagggccccgagcgcgtcatcctggccgggccgatgcccgtgaccgtcgcctccgccgcgcagcggcgcggccggatcggccgcaaccagaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgcgatcgacggcgagtaccggctgcgcggggaggcccggaagaccttcgtggagctgatgcgccggggcgacctccccgtgtggctgtcctacaaggtcgccagcgagggcttccagtactccgaccgccggtggtgcttcgacggggagcgcaacaaccaggtgctggaggagaacatggacgtggagatctggaccaaggagggcgagcggaagaagctccgcccccggtggctggacgcccgcacgtacagcgacccgctggccctccgggagttcaaggagttcgcggccgggcgccggtccgtcagcagcgacctgatcctggagatcggcaagctcccccagcacctgaccctgcgcgcccagaacgccctcgacaacctggtgatgctgcacaactccgagcagggcgggaaggcctaccggcacgcgatggaggagctccccgacaccatcgagaccctgatgctgctcgccctgatcgccgtgctgaccggcggggtcaccctcttcttcctgagcggcaaggggctgggcaagacctccatcggcctcctgtgcgtgatggccagctccgcgctgctctggatggccagcgtggagccccactggatcgccgcctccatcatcctggagttcttcctgatggtcctcctgatcccggagcccgaccgccagcggacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccaccatgctcgacgtcgacctgcgcccggccagcgcgtggaccctgtacgccgtggccacgaccgtgatcacccccatgatgcggcacaccatcgagaacacgaccgccaacatctccctcaccgccatcgcgaaccaggccgccatcctgatggggctggacaagggctggcccatcagcaagatggacatcggcgtccccctcctggccctggggtgctactcccaggtgaacccgctcaccctgacggccgcggtgctgatgctcgtcgcccactacgccatcatcggccccgggctgcaggccaaggcgacccgcgaggcccagaagcgcaccgccgccggcatcatgaagaaccccaccgtggacgggatcgtgacgatcgacctggaccccgtcgtgtacgacgccaagttcgagaagcagctcggccagatcatgctgctgatcctctgcaccagccagatcctgctgatgcggaccacctgggcgctctgcgagtccatcacgctggccaccggcccgctgaccaccctctgggaggggagccccggcaagttctggaacacgaccatcgccgtgtccatggccaacatcttccgcgggagctacctggccggcgcgggcctggccttctccctcatgaagtccctcgggggcgggcggcgcgggaccggggcccagggcgagaccctgggcgagaagtggaagcggcagctcaaccagctgtccaagagcgagttcaacacgtacaagaagtccgggatcatggaggtcgaccgctccgaggccaaggagggcctgaagcgcggggagaccaccaagcacgccgtgagccgcggcaccgcgaagctgcggtggttcgtggagcgcaacctcgtcaagcccgaggggaaggtgatcgacctgggctgcggccgcggcgggtggtcctactactgcgccgggctgaagaaggtgacggaggtcaaggggtacaccaagggcgggcccggccacgaggagccgatccccatggccacctacgggtggaacctcgtgaagctgcacagcggcaaggacgtgttcttcacgccgcccgagaagtgcgacaccctgctctgcgacatcggggagtccagcccgaaccccacgatcgaggagggccgcaccctgcgggtcctgaagatggtggagccctggctccgcgggaaccagttctgcatcaagatcctgaacccctacatgccgtccgtggtcgagaccctggagcagatgcagcggaagcacggcggcatgctcgtgcgcaaccccctgagccggaactccacccacgagatgtactgggtgagctgcgggacgggcaacatcgtctccgccgtgaacatgaccagccgcatgctgctcaaccggttcaccatggcgcaccgcaagcccacctacgagcgcgacgtggacctgggggccggcacgcggcacgtcgccgtggagcccgaggtggccaacctggacatcatcggccagcgcatcgagaacatcaagaacgagcacaagtccacctggcactacgacgaggacaacccgtacaagacctgggcctaccacgggagctacgaggtcaagccctccggcagcgcgtccagcatggtgaacggggtcgtgcggctcctgaccaagccctgggacgtgatccccatggtcacgcagatcgccatgaccgacaccaccccgttcggccagcagcgcgtgttcaaggagaaggtggacacgcggacgccccgggccaagcgggggaccgcccagatcatggaggtcaccgccaagtggctgtggggcttcctctcccgcacgaagaagccccggatctgcacccgcgaggagttcacccggaaggtgcgcagcaacgcggccatcggcgccgtgttcgtcgacgagaaccagtggaacagcgccaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaaggggtcccgggccatctggtacatgtggctgggcgcccgcttcctggagttcgaggcgctcggcttcatgaacgaggaccactggttcagccgggagaactccctgagcggggtggagggcgaggggctgcacaagctcggctacatcctgcgcgacatctccaagatccccggcgggaacatgtacgccgacgacacggccgggtgggacacccggatcaccgaggacgacctgcagaacgaggccaagatcaccgacatcatggagcccgagcacgccctcctggcgacgagcatcttcaagctgacctaccagaacaaggtggtccgcgtgcagcgccccgccaagtccgggaccgtgatggacgtcatcagccggcgcgaccagcggggctccggccaggtgggcacctacggcctcaacacgttcaccaacatggaggtgcagctgatccgccagatggagagcgaggggatcttctcccccagcgagctggagaccccgaacctcgccaagaaggtcctggactggctggagaagcacggcgccgagcggctcaagcgcatggccatctccggggacgactgcgtggtgaagcccatcgacgaccggttcgcgaccgccctgacggccctgaacgacatgggcaaggtccgcaaggacatcccccagtgggagcccagcaaggggtggaacgactggcagcaggtcccgttctgctcccaccacttccaccagctcatcatgaaggacggccgggagatcgtggtcccctgccgcaaccaggacgagctggtgggccgggcccgcgtgagccagggggccggctggtccctgcgggagaccgcgtgcctcggcaagagctacgcccagatgtggcagctgatgtacttccaccgccgggacctgcgcctcgccgccaacgccatctgcagcgcggtccccgtggactgggtgcccacctcccggaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctgggcaagcgggaggaccagtggtgcgggagcctcatcggcctgaccgcccgcgccacgtgggcgaccaacatccaggtggccatcaaccaggtgcgccggctgatcggcaacgagaactacctcgactacatgacctccatgaagcgcttcaagaacgagagcgaccccgagggggccctgtggtga

SEQ ID NO: 8803 - RNA, 9879 nt, synthetic construct
  misc_feature 1..9879: note = derived and/or modified CDS sequence (opt1) from DENV-1__KP188540__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatgctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgcgacgctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgggagggcaagatcgtcgggctgtacggcaacggggtggtgaccaccagcggcacgtacgtctccgccatcgcccaggccaaggcgagccaggaggggcccctgcccgagatcgagaacgaggtgttcaagaagcgcaacctcaccatcatggacctgcacccgggcagcggcaagacccggcgctacctgcccgccatcgtgcgggaggccatcaagcgcaagctccgcaccctgatcctggcccccacgcgggtcgtggcgtccgagatggccgaggccctcaaggggatgcccatccgctaccagaccaccgccgtcaagagcgagcacaccggccgggagatcgtcgacctgatgtgccacgccacgttcaccatgcgcctgctctccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctcaagcccgtcatcctgaaggacgggcccgagcgggtgatcctggccggcccgatgcccgtcaccgtggcgagcgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacctactccgacccgctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccggcggggccaccctcttcttcctgagcggcaagggcctggggaagacctccatcggcctcctgtgcgtgacggccagctccgccctgctctggatggccagcgtcgagccccactggatcgcggcctccatcatcctggagttcttcctgatggtgctcctgatcccggagcccgaccggcagcgcacgccccaggacaaccagctggcctacgtggtcatcgggctcctgttcatgatcctgaccgtggccgccaacgagatgggcctcctggagaccacgaagaaggacctggggatcggctacgtggcggccgagaaccaccagcacgccaccatgctcgacgtcgacctgcacccggccagcgcctggaccctgtacgcggtggccaccacggtgatcacccccatgatgcggcacaccatcgagaacaccacggccaacatctccctcaccgccatcgccaaccaggcggccatcctgatgggcctggacaaggggtggcccatcagcaagatggacatcggcgtccccctcctggccctggggtgctactcccaggtgaacccgctcaccctgaccgccgcggtgctgatgctcgtcgcccactacgccatcatcggccccgggctgcaggccaaggccacgcgcgaggcgcagaagcgcaccgccgccggcatcatgaagaaccccaccgtggacggcatcgtggccatcgacctggaccccgtcgtgtacgacgccaagttcgagaagcagctcgggcagatcatgctgctgatcctctgcaccagccagatcctgctgatgcggacgacctgggcgctctgcgagtccatcaccctggccaccggcccgctgacgaccctctgggaggggagccccggcaagttctggaacaccaccatcgccgtgtccatggccaacatcttccgcggcagctacctggccggggcgggcctggccttctccctcatgaagtccctcgggggcgggcggcgcgggacgggcgcccagggggagaccctgggcgagaagtggaagcggcagctcaaccagctgtccaagagcgagttcaacacctacaagcgcagcgggatcatggaggtcgaccggtccgaggccaaggagggcctgaagcgcggggagaccacgaagcacgcggtgagccggggcaccgccaagctccgctggttcgtggagcggaacctggtcaagcccgagggcaaggtgatcgacctggggtgcggccgcgggggctggtcctactactgcgccgggctgaagaaggtgaccgaggtcaagggctacaccaagggcgggcccggccacgaggagccgatccccatggccacctacgggtggaacctcgtgaagctgcacagcggcaaggacgtgttcttcatgccgcccgagaagtgcgacacgctgctctgcgacatcggggagtccagcccgaaccccaccatcgaggagggccggaccctgcgcgtcctgaagatggtggagccctggctccggggcaaccagttctgcatcaagatcctgaacccctacatgccgtccgtggtcgagaccctggagcagatgcagcgcaagcacgggggcatgctcgtgcggaaccccctgagccgcaactccacgcacgagatgtactgggtgagctgcgggaccggcaacatcgtctccgccgtgaacatgaccagccggatgctgctcaaccgcttcaccatggcgcaccgcaagcccacgtacgagcgggacgtggacctgggcgccgggacccgccacgtcgccgtggagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcgtccagcatggtgaacggggtcgtgcgcctcctgacgaagccctgggacgtgatccccatggtcacccagatcgccatgaccgacaccacgccgttcggccagcagcgggtgttcaaggagaaggtggacacccgcacgccccgggccaagcgcggcaccacgcagatcatggaggtcaccgccaagtggctgtgggggttcctctcccggaacaagaagccccgcatctgcacccgggaggagttcacccgcaaggtgcggagcaacgccgcgatcggcgccgtgttcgtcgacgagaaccagtggaacagcgccaaggaggccgtggaggacgagcgcttctgggacctggtgcaccgggagcgcgagctgcacaagcaggggaagtgcgcgacgtgcgtctacaacatgatgggcaagcgggagaagaagctcggggagttcggcaaggccaagggctcccgcgccatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgcggacgacaccgccggctgggacacccgcatcaccgaggacgacctgcagaacgaggccaagatcacggacatcatggagcccgagcacgccctcctggccaccagcatcttcaagctgacctaccagaacaaggtggtccgcgtgcagcggcccgcgaagaacgggaccgtgatggacgtcatctcccgccgggaccagcgcggcagcggccaggtggggacgtacggcctcaacaccttcaccaacatggaggtgcagctgatccggcagatggagtccgaggggatcttcctgcccagcgagctcgagaccccgaacctggccgagcgcgccctggactggctcgagaagcacggcgccgagcggctgaagcgcatggccatctccggggacgactgcgtcgtgaagcccatcgacgaccggttcgcgacggccctgaccgccctcaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctggtcggccgggcccgcgtgagccagggggccggctggtccctccgggagaccgcgtgcctgggcaagagctacgcccagatgtggcagctgatgtacttccaccgccgggacctccgcctggccgccaacgcgatctgctccgccgtgcccgtcgactgggtgcccgccagccggaccacctggagcatccacgcccaccaccagtggatgacgaccgaggacatgctgtccgtgtggaaccgcgtctggatcgaggagaacccgtggatggaggacaagacccacgtgagctcctgggaggaggtgccctacctcggcaagcgcgaggaccagtggtgcggcagcctgatcgggctgaccgcccgggcgacgtgggccaccaacatccaggtcgccatcaaccaggtgcgccggctcatcggcaacgagaactacctggactacatgacctccatgaagcgcttcaagaacgagagcgaccccgagggggccctgtggtga

SEQ ID NO: 8804 - RNA, 9879 nt, synthetic construct
  misc_feature 1..9879: note = derived and/or modified CDS sequence (opt1) from DENV-1__KP188541__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcccgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcgggctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcttcatcaccgagaacaagatctgggggcggaagtcctggcccctgaacgagggcatcatggccatcgggatcgtgagcatcctcctgtccagcctgctcaagaacgacgtccccctggcgggcccgctgatcgccggcgggatgctcatcgcctgctacgtgatcagcggctccagcgccgacctgtccctggagaaggccgcggaggtgagctgggagcaggaggccgagcactccggggccagccacaacatcctcgtcgaggtgcaggacgacggcacgatgaagatcaaggacgaggagcgcgacgacaccctgaccatcctgctcaaggccaccctgctggccgtgtccggggtctaccccatgagcatccccgcgaccctcttcgtgtggtacttctggcagaagaagaagcagcggtccggcgtgctgtgggacacccccagcccgcccgaggtcgagcgcgccgtgctggacgacggcatctaccggatcctccagcgcgggctgctgggccggtcccaggtgggggtcggcgtgttccaggacggggtgttccacaccatgtggcacgtcacccgcggcgccgtgctgatgtaccagggcaagcggctcgagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgggagggcaagatcgtcgggctctacggcaacggggtggtgaccaccagcggcacgtacgtctccgccatcgcccaggccaaggcgagccaggaggggcccctgcccgagatcgagaacgaggtgttcaagaagcgcaacctgaccatcatggacctccacccgggcagcggcaagacccggcgctacctgcccgccatcgtgcgggaggccatcaagcgcaagctgcgcaccctcatcctggcccccacgcgggtcgtggcgtccgagatggccgaggccctgaaggggatgcccatccgctaccagaccaccgccgtcaagagcgagcacaccggccgggagatcgtcgacctcatgtgccacgccacgttcaccatgcgcctgctgtccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctccgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctgaagcccgtcatcctcaaggacgggcccgagcgggtgatcctggccggcccgatgcccgtcaccgtggcgagcgccgcccagcgccggggccgcatcgggcgcaaccagaacaaggagggcgaccagtacgtgtacatggggcagcccctgaacaacgacgaggaccacgcccactggaccgaggccaagatgctcctggacaacatcaacacccccgagggcatcatcccggcgctgttcgagcccgagcgggagaagtccgccgccatcgacggggagtaccgcctccggggcgaggcccgcaagacgttcgtcgagctgatgcggcgcggcgacctgcccgtgtggctcagctacaaggtggcctccgaggggttccagtacagcgaccggcgctggtgcttcgacggcgagcggaacaaccaggtcctggaggagaacatggacgtggagatctggaccaaggagggggagcgcaagaagctgcggccccgctggctcgacgcgcggacctactccgacccgctggccctgcgcgagttcaaggagttcgccgccggccggcgcagcgtgagcggcgacctcatcctggagatcgggaagctgccccagcacctcaccctgcgggcccagaacgcgctggacaacctcgtcatgctgcacaactccgagcagggcgggaaggcctaccgccacgccgtggaggagctgcccgacaccatcgagacgctcatgctgctggccctcatcgcggtgctgaccggcggggtcaccctgttcttcctcagcggcaagggcctggggaagacctccatcggcctgctctgcgtgacggccagctccgccctgctgtggatggccagcgtggagccccactggatcgccgcgtccatcatcctcgagttcttcctgatggtcctgctcatcccggagcccgaccggcagcgcacgccccaggacaaccagctggcctacgtggtgatcgggctcctcttcatgatcctgaccgtcgccgccaacgagatgggcctgctcgagaccacgaagaaggacctggggatcggctacgtggccgcggagaaccaccagcacgccaccatgctggacgtggacctccacccggccagcgcctggaccctgtacgccgtcgcgaccacggtgatcacccccatgatgcggcacaccatcgagaacaccacggccaacatctccctgaccgccatcgccaaccaggccgcgatcctcatgggcctggacaaggggtggcccatcagcaagatggacatcggcgtgcccctgctcgccctggggtgctactcccaggtcaacccgctgaccctcaccgccgccgtgctgatgctggtggcgcactacgccatcatcggccccgggctccaggccaaggccacgcgcgaggcccagaagcgcaccgcggccggcatcatgaagaaccccaccgtcgacggcatcgtggccatcgacctggaccccgtggtctacgacgccaagttcgagaagcagctggggcagatcatgctcctgatcctgtgcaccagccagatcctcctgatgcggacgacctgggccctgtgcgagtccatcaccctcgcgaccggcccgctgacgaccctgtgggaggggagccccggcaagttctggaacaccaccatcgccgtgtccatggccaacatcttccgcggcagctacctcgccggggccggcctggcgttctccctgatgaagtccctcgggggcgggcggcgcggcacgggcgcccagggggagaccctgggcgagaagtggaagcggcagctgaaccagctctccaagagcgagttcaacacctacaagcgcagcgggatcatggaggtggaccggtccgaggccaaggagggcctgaagcgcggggagaccacgaagcacgccgtcagccggggcaccgcgaagctgcgctggttcgtggagcggaacctcgtgaagcccgagggcaaggtcatcgacctggggtgcggccgcgggggctggtcctactactgcgccgggctgaagaaggtgaccgaggtgaagggctacaccaagggcgggcccggccacgaggagccgatccccatggccacctacgggtggaacctggtcaagctccacagcggcaaggacgtgttcttcatgccgcccgagaagtgcgacacgctgctgtgcgacatcggggagtccagcccgaaccccaccatcgaggagggccggaccctccgcgtgctgaagatggtcgagccctggctgcggggcaaccagttctgcatcaagatcctcaacccctacatgccgtccgtggtggagaccctggagcagatgcagcgcaagcacgggggcatgctggtccggaaccccctcagccgcaactccacgcacgagatgtactgggtgagctgcgggaccggcaacatcgtgtccgccgtcaacatgaccagccggatgctgctgaaccgcttcaccatggcccaccgcaagcccacgtacgagcgggacgtggacctcggcgcggggacccgccacgtggccgtcgagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctgctcacgaagccctgggacgtgatccccatggtgacccagatcgcgatgaccgacaccacgccgttcggccagcagcgggtcttcaaggagaaggtggacacccgcacgccccgggccaagcgcggcaccacgcagatcatggaggtgaccgccaagtggctgtgggggttcctgtcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctcgtgcaccgggagcgcgagctgcacaagcaggggaagtgcgccacgtgcgtgtacaacatgatgggcaagcgggagaagaagctgggggagttcggcaaggcgaagggctcccgcgccatctggtacatgtggctcggggcccggttcctggagttcgaggccctgggcttcatgaacgaggaccactggttcagccgcgagaactccctcagcggggtcgagggcgaggggctgcacaagctgggctacatcctccgggacatctccaagatcccgggcgggaacatgtacgccgacgacaccgcgggctgggacacccgcatcaccgaggacgacctgcagaacgaggccaagatcacggacatcatggagcccgagcacgccctgctcgccaccagcatcttcaagctgacctaccagaacaaggtggtgcgcgtccagcggcccgccaagaacgggaccgtgatggacgtgatctcccgccgggaccagcgcggcagcggccaggtcgggacgtacggcctgaacaccttcaccaacatggaggtgcagctcatccggcagatggagtccgaggggatcttcctgcccagcgagctggagaccccgaacctcgcggagcgcgccctggactggctggagaagcacggcgccgagcggctcaagcgcatggccatctccggggacgactgcgtggtcaagcccatcgacgaccggttcgccacggcgctgaccgccctgaacgacatgggcaaggtgcgcaaggacatcccccagtgggagcccagcaagggctggaacgactggcagcaggtcccgttctgctcccaccacttccaccagctcatcatgaaggacgggcgggagatcgtcgtgccctgccgcaaccaggacgagctggtgggccgggcccgcgtcagccagggggccggctggtccctgcgggagaccgcctgcctcggcaagagctacgcgcagatgtggcagctgatgtacttccaccgccgggacctgcgcctcgccgccaacgccatctgctccgcggtgcccgtggactgggtccccgccagccggaccacctggagcatccacgcccaccaccagtggatgacgaccgaggacatgctgtccgtgtggaaccgcgtgtggatcgaggagaacccgtggatggaggacaagacccacgtcagctcctgggaggaggtgccctacctgggcaagcgcgaggaccagtggtgcggcagcctcatcgggctgaccgcccgggccacgtgggcgaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8805 - RNA, 9879 nt, synthetic construct
  misc_feature 1..9879: note = derived and/or modified CDS sequence (opt1) from DENV-1__KP188543__SS-prME
  source 1..9879: mol_type = other RNA
agcgtgaccatgctgctcatgctgctgcccaccgccctcgccttccacctgaccacccggggcggggagccccacatgatcgtcagcaagcaggagcggggcaagagcctcctcttcaagaccagcgtgggggtgaacatgtgcaccctgatcgccatggacctgggcgagctctgcgaggacaccatgacctacaagtgcccccgcatcaccgaggtcgagcccgacgacgtggactgctggtgcaacgccaccgacacctgggtgacctacgggacctgcagccagaccggcgagcaccggcgcgacaagcggtccgtcgccctggcgccccacgtgggcctggggctcgagacgcgcaccgagacctggatgagctccgagggcgcctggaagcagatccagaaggtggagacctgggcgctgcggcaccccgggttcacggtcatcgccctgttcctcgcccacgccatcggcaccagcatcacccagaaggggatcatcttcatcctgctgatgctcgtgaccccctccatggcgatgcgctgcgtgggcatcggcaaccgggacttcgtcgaggggctgagcggcgccacgtgggtggacgtggtcctggagcacgggtcctgcgtgaccaccatggccaagaacaagcccaccctcgacatcgagctgctgaagacggaggtgaccaaccccgccgtcctccgcaagctgtgcatcgaggccaagatcagcaacaccaccacggactcccggtgccccacccagggcgaggcgaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtccacaccggcgaccagcaccaggtggggaacgagacgaccgagcacggcaccatcgccaccatcacgccccaggcccccacgagcgagatccagctgaccgactacggggcgctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgccaagaagcaggaggtggtcgtgctgggctcccaggagggcgccatgcacaccgcgctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtcgccgagacccagcacggcacggtgctggtgcaggtcaagtacgagggcaccgacgccccctgcaagatccccttcctcacccaggacgagaagggggtgacccagaacggccgcctgatcacggcgaacccgatcgtgaccgacaaggagaagcccgtcaacatcgagaccgagccgcccttcggggagtcctacatcgtggtgggcgccggcgagaaggccctgaagctcagctggttcaagaaggggtccagcatcggcaagatgttcgaggccaccgcgcgcggggcccgccggatggccatcctgggcgacacggcctgggacttcgggtccatcggcggcctgttcaccagcgtcgggaagctcatccaccaggtgttcggcaccgcctacggggtgctgttctccggcgtcagctggaccatgaagatcgggatcggcatcctgctcacgtggctgggcctgaactcccgcagcacctccctcagcatgacctgcatcgcggtggggatggtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggccgactccccgaagcggctgagcgccgccatcggcaaggcgtgggaggagggggtgtgcggcatccgcagcgccacccggctggagaacatcatgtggaagcagatctccaacgagctcaactacatcctgctggagaacgacatgaagttcaccgtcgtggtgggggacgtcaacggcatcctcgcccaggggaagaagatgatccgcccccagcccatggagcacaagtacagctggaagtcctggggcaaggccaagatcatcggcgccgacatccagaacacgaccttcatcatcgacgggcccgacaccccggagtgccccgacgaccagcgggcgtggaacatctgggaggtggaggactacggcttcgggatcttcaccacgaacatctggctgaagctgcgcgacagccacacccagatgtgcgaccaccggctcatgtccgccgccatcaaggacagcaaggccgtgcacgcggacatgggctactggatcgagtccgagaagaacgagacctggaagctggcccgcgccagcttcatcgaggtcaagacctgcatctggcccaagtcccacacgctgtggagcaacggcgtgctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtcgtggtggacgagcactgcggctaccgcgggccgtccctgcggaccaccaccgtcacgggcaagatcatccacgagtggtgctgccgcagctgcaccctgccgcccctgcggttccgcggggaggacggctgctggtacgggatggagatccggcccgtgaaggagaaggaggagaacctggtgcgctccatggtcagcgccggctccggcgagatggacagcttcagcctcgggatcctgtgcgtgtccatcctgatcgaggaggtgatgcggagccgctggtcccggaagatgctcatgaccggcaccctggcggtcttcctgctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgcggtgggcctgctgttccgccggctcacgtcccgcgaggtcctgctgctcaccgtggggctgagcctggtcgcctccgtggagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcctggaagaccatggccatggcgctgagcatcgtgtccctgttccccctctgcctgagcacgacctcccagaagaccacctggctgccggtcctcctgggcagcttcgggtgcaagcccctgacgatgttcctcatcaccgagaacaagatctggggccgcaagtcctggcccatcaacgaggggatcatggccgtgggcatcgtgagcatcctgctgtccagcctcctgaagaacgacgtccccctggccgggccgctcatcgccggcggcatgctgatcgcgtgctacgtgatcagcgggtccagcgccgacctgtccctcgagaaggccgccgaggtgagctgggaggaggaggccgagcactccggcaccagccacaacatcctggtcgaggtgcaggacgacgggaccatgaagatcaaggacgaggagcgggacgacaccctgacgatcctcctgaaggcgaccctgctcgccgtgtccggcgtctaccccatgagcatccccgccaccctgttcgtgtggtacttctggcagaagaagaagcagcgctccggggtgctgtgggacacccccagcccgcccgaggtcgagcgggccgtgctggacgacggcatctaccgcatcctccagcggggcctgctggggcgctcccaggtgggcgtcggggtgttccaggacggcgtgttccacacgatgtggcacgtcacccgcggggccgtgctcatgtaccagggcaagcgcctggagcccagctgggcgtccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggccatcgccctcgacttcaagcccggcaccagcgggtccccgatcgtgaaccgcgagggcaagatcgtcggcctgtacgggaacggcgtggtgacgaccagcgggacctacgtctccgccatcgcgcaggccaaggccacccaggagggccccctgcccgagatcgaggacgaggtgttcaagaagcggaacctcacgatcatggacctgcacccggggagcggcaagacccgccggtacctgcccgccatcgtgcgcgaggccatcaagcggaagctccgcaccctgatcctggcgcccacccgcgtcgtggccagcgagatggccgaggccctcaagggcatgcccatccggtaccagacgaccgcggtgaagtccgagcacaccgggcgcgagatcgtcgacctgatgtgccacgccaccttcacgatgcggctgctcagcccggtgcgcgtgcccaactacaacatgatcatcatggacgaggcccacttcaccgaccccgcctccatcgccgcgcggggctacatcagcacccgcgtcgggatgggcgaggccgccgccatcttcatgaccgccacgcccccggggtccgtggaggcgttcccccagagcaacgccgtgatccaggacgaggagcgggacatccccgagcgctcctggaacagcggctacgactggatcaccgacttccccggcaagaccgtctggttcgtgccgtccatcaagagcgggaacgacatcgccaactgcctgcggaagaacggcaagcgcgtgatccagctgtcccggaagaccttcgacacggagtaccagaagaccaagaacaacgactgggactacgtcgtgaccaccgacatcagcgagatgggggccaacttccgcgccgaccgggtgatcgacccccgccggtgcctcaagcccgtcatcctgaaggagggccccgagcgcgtgatcctggcggggccgatgcccgtcacggtggcctccgccgcccagcggcgcggccggatcggccgcaaccagaacaaggagggggaccagtacatctacatgggccagcccctcaacaacgacgaggaccacgcgcactggaccgaggccaagatgctgctggacaacatcaacacccccgaggggatcatcccggccctcttcgagcccgagcgcgagaagtccgccgccatcgacggcgagtaccggctgcgcggggaggcgcggaagaccttcgtggagctgatgcgccggggcgacctccccgtctggctgtcctacaaggtggccagcgagggcttccagtactccgaccgccggtggtgcttcgacggggagcgcaacaaccaggtgctggaggagaacatggacgtcgagatctggacgaaggagggcgagcggaagaagctccgcccccggtggctggacgcccgcacctacagcgacccgctggccctccgggagttcaaggagttcgccgcggggcgccggtccgtgagcggcgacctgatcctggagatcggcaagctcccccagcacctgaccctgcgcgcccagaacgccctcgacaacctggtgatgctgcacaacagcgagcagggcgggaaggcctaccggcacgccatggaggagctccccgacaccatcgagaccctgatgctgctcgcgctgatcgccgtcctgaccggcggggtgaccctcttcttcctgtccgggaaggggctgggcaagaccagcatcgggctcctgtgcgtgatggcctccagcgccctgctctggatggcgtccgtcgagccccactggatcgccgccagcatcatcctggagttcttcctgatggtgctcctgatcccggagcccgaccgccagcggacgccccaggacaaccagctggcctacgtggtcatcggcctcctgttcatgatcctgacggtggccgcgaacgagatggggctcctggagaccaccaagaaggacctgggcatcgggcacgtggccgtcgagaaccaccaccacgccaccatgctcgacgtggacctgcgcccggcctccgcctggacgctgtacgcggtggccaccaccgtcatcacccccatgatgcggcacacgatcgagaacaccaccgccaacatcagcctcaccgccatcgccaaccaggcggccatcctgatgggcctggacaagggctggcccatctccaagatggacatcggggtgcccctcctggccctgggctgctacagccaggtgaacccgctcacgctgaccgccgccgtcctgatgctcgtggcgcactacgccatcatcgggcccggcctgcaggccaaggccacccgcgaggcgcagaagcgcaccgccgccgggatcatgaagaaccccacggtggacggcatcgtcaccatcgacctggaccccgtggtgtacgacgccaagttcgagaagcagctcggccagatcatgctgctgatcctctgcacctcccagatcctgctgatgcggaccacgtgggccctctgcgagagcatcaccctggcgaccgggccgctgaccacgctctgggagggctcccccgggaagttctggaacaccaccatcgccgtcagcatggccaacatcttccgcggctcctacctggccggcgccgggctggcgttcagcctcatgaagtccctgggcgggggccggcgcgggaccggcgcccagggcgagacgctgggggagaagtggaagcggcagctcaaccagctgagcaagtccgagttcaacacctacaagaagtccggcatcatggaggtggaccgcagcgaggccaaggaggggctgaagcggggcgagaccaccaagcacgccgtgtcccgcgggacggccaagctgcggtggttcgtcgagcgcaacctcgtgaagcccgagggcaaggtggtcgacctgggctgcgggcggggcgggtggagctactactgcgcgggcctgaagaaggtgaccgaggtgaaggggtacaccaagggcggccccgggcacgaggagccgatccccatggccacctacggctggaacctcgtcaagctgcactccgggaaggacgtgttcttcacgccgcccgagaagtgcgacacgctgctctgcgacatcggcgagagctccccgaaccccaccatcgaggaggggcgcaccctgcgggtgctgaagatggtcgagccctggctccgcggcaaccagttctgcatcaagatcctgaacccctacatgccgagcgtggtggagaccctggagcagatgcagcggaagcacggcgggatgctcgtccgcaaccccctgtcccggaacagcacgcacgagatgtactgggtgtcctgcggcaccgggaacatcgtgagcgccgtcaacatgacctcccgcatgctgctcaaccggttcaccatggcccaccgcaagcccacgtacgagcgcgacgtggacctgggcgcgggcacccggcacgtggccgtcgagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgccagctccatggtgaacggcgtggtccggctcctgacgaagccctgggacgtgatccccatggtgacccagatcgcgatgaccgacaccacgccgttcgggcagcagcgcgtcttcaaggagaaggtggacacccggacgccccgggccaagcggggcaccgcccagatcatggaggtgacggccaagtggctgtggggcttcctcagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgcggacgacacggccgggtgggacacccggatcaccgaggacgacctgcagaacgaggccaagatcaccgacatcatggagcccgagcacgccctcctggccacgtccatcttcaagctgacctaccagaacaaggtggtgcgcgtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaccccgaacctcgccaagaaggtgctggactggctggagaagcacggggccgagcggctcaagcgcatggccatcagcggcgacgactgcgtcgtgaagcccatcgacgaccggttcgccaccgcgctgacggccctgaacgacatggggaaggtgcgcaaggacatcccccagtgggagccctccaagggctggaacgactggcagcaggtcccgttctgcagccaccacttccaccagctcatcatgaaggacggccgggagatcgtggtgccctgccgcaaccaggacgagctggtcgggcgggcccgcgtgtcccagggcgccgggtggagcctgcgggagaccgcctgcctcggcaagtcctacgcgcagatgtggcagctgatgtacttccaccgccgggacctgcgcctcgccgccaacgccatctgcagcgccgtgcccgtcgactgggtgcccaccagccggaccacctggtccatccacgcgcaccaccagtggatgacgaccgaggacatgctgagcgtgtggaaccgcgtctggatcgaggagaacccgtggatggagaacaagacccacgtgtccagctgggaggaggtgccctacctggggaagcgggaggaccagtggtgcggctccctcatcggcctgaccgcccgcgccacgtgggccaccaacatccaggtcgcgatcaaccaggtgcgccggctgatcgggaacgagaactacctcgactacatgaccagcatgaagcgcttcaagaacgagtccgaccccgagggcgccctgtggtga

SEQ ID NO: 8806 - RNA, 9879 nt, synthetic construct
  misc_feature 1..9879: note = derived and/or modified CDS sequence (opt1) from DENV-1__KP188544__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgaggtcgacagcttcagcctcgggatcctgtgcgtgtccatcctgatcgaggaggtgatgcggagccgctggtcccggaagatgctcatgaccggcaccctggccgtcttcctgctcctgatcatggggcagctgacgtggaacgacctcatccgcctgtgcatcatggtgggcgccaacgccagcgaccgcatggggatgggcaccacctacctggccctcatggcgaccttcaagatgcggccgatgttcgccgtgggcctgctgttccgccggctcacgtgccgcgaggtcctgctgctcaccgtggggctgtccctggtcgccagcgtggagctccccaactccctggaggagctgggcgacgggctcgccatgggcatcatgatgctgaagctgctcaccgacttccagccccaccagctgtggaccacgctgctcagcctgaccttcatccggacctccctgagcctcgactacgcctggaagaccatggcgatggccctgtccatcgtgagcctgttccccctctgcctgtccacgaccagccagaagaccacctggctgccggtcctcctgggctccttcgggtgcaagcccctgacgatgttcctcatcaccgagaacaagatctggggccgcaagagctggcccatcaacgaggggatcatggccgtgggcatcgtgtccatcctgctgagctccctcctgaagaacgacgtccccctggccgggccgctcatcgcgggcggcatgctgatcgcctgctacgtgatcagcgggagctccgccgacctgagcctcgagaaggccgccgaggtgtcctgggaggaggaggcggagcacagcggcacctcccacaacatcctggtcgaggtgcaggacgacgggaccatgaagatcaaggacgaggagcgggacgacaccctgacgatcctcctgaaggccaccctgctcgccgtgagcggcgtctaccccatgtccatccccgccaccctgttcgtgtggtacttctggcagaagaagaagcagcgcagcggggtgctgtgggacaccccctccccgcccgaggtcgagcgggccgtgctggacgacggcatctaccgcatcctccagcggggcctgctggggcgcagccaggtgggcgtcggggtgttccaggacggcgtgttccacacgatgtggcacgtcacccgcggggcggtgctcatgcaccagggcaagcgcctggagccctcctgggccagcgtgaagaaggacctgatctcctacggcgggggctggcggttccaggggagctggaacaccggcgaggaggtccaggtgatcgccgtggagcccgggaagaacccgaagaacgtccagaccacgcccggcaccttcaagacccccgagggcgaggtgggggccatcgccctcgacttcaagcccggcacctccgggagcccgatcgtgaaccgcgagggcaagatcgtcggcctgtacgggaacggcgtggtgacgacctccgggacctacgtcagcgcgatcgcccaggccaaggccacccaggagggccccctgcccgagatcgaggacgaggtgttcaagaagcggaacctcacgatcatggacctgcacccggggtccggcaagacccgccggtacctgcccgccatcgtgcgcgaggcgatcaagcggaagctccgcaccctgatcctggcccccacccgcgtcgtggccagcgagatggccgaggcgctcaagggcatgcccatccggtaccagacgaccgccgtcaagagcgagcacaccgggcgcgagatcgtcgacctgatgtgccacgccaccttcacgatgcggctgctctccccggtgcgcgtgcccaactacaacatgatcatcatggacgaggcccacttcaccgaccccgccagcatcgcggcccggggctacatctccacccgcgtcgggatgggcgaggccgccgccatcttcatgaccgcgacgcccccggggagcgtggaggccttcccccagtccaacgccgtgatccaggacgaggagcgggacatccccgagcgcagctggaactccggctacgactggatcaccgacttccccggcaagaccgtctggttcgtgccgagcatcaagtccgggaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggccaacttccgcgcggaccgggtgatcgacccccgccggtgcctcaagcccgtcatcctgaaggagggccccgagcgcgtgatcctggccgggccgatgcccgtcacggtggccagcgccgcgcagcggcgcggccggatcggccgcaaccagaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagtccgccgcgatcgacggcgagtaccggctgcgcggggaggcccggaagaccttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggacgaaggagggcgagcggaagaagctccgcccccggtggctggacgcccgcacctactccgacccgctggccctccgggagttcaaggagttcgcggccgggcgccggagcgtgtccggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacaccatcgagaccctgatgctgctcgccctgatcgccgtcctgaccggcggggtgaccctcttcttcctgagcgggaaggggctgggcaagacctccatcgggctcctgtgcgtgatggccagctccgcgctgctctggatggccagcgtcgagccccactggatcgccgcctccatcatcctggagttcttcctgatggtgctcctgatcccggagcccgaccgccagcggacgccccaggacaaccagctggcctacgtggtcatcggcctcctgttcatgatcctgacggtggcggccaacgagatggggctcctggagaccaccaagaaggacctgggcatcgggcacgtggccgtcgagaaccaccaccacgccaccatgctcgacgtggacctgcgcccggccagcgcgtggacgctgtacgccgtggccaccaccgtcatcacccccatgatgcggcacacgatcgagaacaccaccgccaacatctccctcaccgccatcgcgaaccaggccgccatcctgatgggcctggacaagggctggcccatcagcaagatggacatcggggtgcccctcctggccctgggctgctactcccaggtgaacccgctcacgctgaccgccgcggtcctgatgctcgtggcccactacgccatcatcgggcccggcctgcaggccaaggcgacccgcgaggcccagaagcgcaccgccgccgggatcatgaagaaccccacggtggacggcatcgtcaccatcgacctggaccccgtggtgtacgacgccaagttcgagaagcagctcggccagatcatgctgctgatcctctgcaccagccagatcctgctgatgcggaccacgtgggcgctctgcgagtccatcaccctggccaccgggccgctgaccacgctctgggagggcagccccgggaagttctggaacaccaccatcgccgtctccatggccaacatcttccgcggcagctacctggccggcgcggggctggccttctccctcatgaagtccctgggcgggggccggcgcgggaccggcgcccagggcgagacgctgggggagaagtggaagcggcagctcaaccagctgtccaagagcgagttcaacacctacaagaagtccggcatcatggaggtggaccgcagcgaggccaaggaggggctgaagcggggcgagaccaccaagcacgccgtgagccgcgggacggcgaagctgcggtggttcgtcgagcgcaacctcgtgaagcccgagggcaaggtgatcgacctgggctgcgggcggggcgggtggtcctactactgcgccggcctgaagaaggtcaccgaggtgaaggggtacaccaagggcggccccgggcacgaggagccgatccccatggccacctacggctggaacctcgtgaagctgcacagcgggaaggacgtcttcttcacgccgcccgagaagtgcgacacgctgctctgcgacatcggcgagtccagcccgaaccccaccatcgaggaggggcgcaccctgcgggtgctgaagatggtggagccctggctccgcggcaaccagttctgcatcaagatcctgaacccctacatgccgtccgtcgtggagaccctggagcagatgcagcggaagcacggcgggatgctcgtgcgcaaccccctgagccggaactccacgcacgagatgtactgggtcagctgcggcaccgggaacatcgtgtccgccgtgaacatgaccagccgcatgctgctcaaccggttcaccatggcgcaccgcaagcccacgtacgagcgcgacgtcgacctgggcgccggcacccggcacgtggccgtggagcccgaggtcgccaacctggacatcatcgggcagcgcatcgagaacatcaagaacgagcacaagtccacctggcaccacgacgaggacaacccgtacaagacctgggcctaccacggcagctacgaggtgaagccctccgggagcgcgtccagcatggtcaacggcgtggtgcggctcctgacgaagccctgggacgtcatccccatggtgacccagatcgccatgaccgacaccacgccgttcgggcagcagcgcgtgttcaaggagaaggtcgacacccggacgccccgggccaagcggggcaccgcccagatcatggaggtgacggccaagtggctgtggggcttcctctcccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttcagccgggagaactccctgagcggcgtggagggggagggcctgcacaagctcgggtacatcctgcgcgacatctccaagatcccgggcggcaacatgtacgccgacgacacggccgggtgggacacccggatcaccgaggacgacctgcagaacgaggccaagatcaccgacatcatggagcccgagcacgccctcctggcgacgagcatcttcaagctgacctaccagaacaaggtcgtgcgcgtgcagcgccccgccaagtccggcaccgtcatggacgtgatcagccggcgcgaccagcgggggtccggccaggtgggcacctacgggctcaacacgttcaccaacatggaggtccagctgatccgccagatggagagcgagggcatcttctcccccagcgagctggagaccccgaacctcgccaagaaggtgctggactggctggagaagcacggggccgagcggctcaagcgcatggccatctccggcgacgactgcgtggtcaagcccatcgacgaccggttcgcgaccgccctgacggccctgaacgacatggggaaggtgcgcaaggacatcccccagtgggagcccagcaagggctggaacgactggcagcaggtcccgttctgctcccaccacttccaccagctcatcatgaaggacggccgggagatcgtcgtgccctgccgcaaccaggacgagctggtggggcgggcccgcgtcagccagggcgccgggtggtccctgcgggagaccgcgtgcctcggcaagagctacgcccagatgtggcagctgatgtacttccaccgccgggacctgcgcctcgccgccaacgccatctgctccgcggtgcccgtggactgggtccccaccagccggaccacctggagcatccacgcccaccaccagtggatgacgaccgaggacatgctgtccgtgtggaaccgcgtgtggatcgaggagaacccgtggatggaggacaagacccacgtcagctcctgggaggaggtgccctacctggggaagcgggaggaccagtggtgcggcagcctcatcggcctgaccgcccgcgccacgtgggcgaccaacatccaggtggccatcaaccaggtccgccggctgatcgggaacgagaactacctcgactacatgacctccatgaagcgcttcaagaacgagagcgaccccgagggcgccctgtggtga

SEQ ID NO: 8807 - RNA, 9879 nt, synthetic construct
  misc_feature 1..9879: note = derived and/or modified CDS sequence (opt1) from DENV-1__KP188547__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacacgatgacctacaagtgcccccggatcaccgaggccgagcccgacgacgtcgactgctggtgcaacgccaccgacacctgggtgacctacgggacctgcagccagaccggcgagcaccggcgggacaagcggtccgtggccctggcgccccacgtcggcctggggctcgagacgcgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccatcctccgcaagctgtgcatcgaggcgaagatcagcaacaccaccacggactcccggtgccccacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgccaccatcacgccccaggcgcccacgagcgagatccagctgaccgactacggggccctcaccctggactgcagcccccggaccggcctggacttcaacgagatggtcctcctgacgatgaaggagaagtcctggctggtgcacaagcagtggttcctcgacctgcccctgccctggacctccggggccagcaccagccaggagacctggaaccgccaggacctcctggtgacgttcaagaccgcccacgccaagaagcaggaggtcgtggtgctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggccgagacccagcacggcacggtgctggtccaggtgaagtacgagggcaccgacgcgccctgcaagatccccttcctcacccaggacgagaagggggtgacccagaacggccgcctgatcacggccaacccgatcgtcaccgacaaggagaagcccgtgaacatcgagaccgagccgcccttcggggagtcctacatcgtggtcggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtgttcggcaccgcgtacggggtcctgttctccggcgtgagctggaccatgaagatcgggatcggcatcctgctcacgtggctgggcctgaactcccgcagcacctccctcagcatgacctgcatcgccgtggggatggtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgactccccgaagcggctgagcgccgcgatcggcaaggcctgggaggagggggtctgcggcatccgcagcgccacccggctggagaacatcatgtggaagcagatctccaacgagctcaactacatcctgctggagaacgacatgaagttcaccgtggtggtcggggacgtgaacggcatcctcgcccaggggaagaagatgatcaagccccagcccatggagcacaagtacagctggaagtcctggggcaaggccaagatcatcggcgcggacatccagaacacgaccttcatcatcgacgggcccgacaccccggagtgccccgacgaccagcgcgcctggaacatctgggaggtggaggactacggcttcgggatcttcaccacgaacatctggctgaagctgcgggacagccacacccagatgtgcgaccaccgcctcatgtccgccgccatcaaggacagcaaggcggtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatggtcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggctaccgggggccgtccctgcgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctggtccggtccatggtgagcgcgggctccggcgaggtggacagcttcagcctcgggatcctgtgcgtctccatcctgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgccctggaccgcatggggatgggcaccacctacctcgccctgatggccaccttcaagatgcgcccgatgttcgccgtggggctcctcttccggcgcctgacgagccgggaggtgctgctcctgaccgtcgggctgtccctcgtggccagcgtcgagctgccctccagcctggaggagctcggcgacgggctggccatgggcatcatgatgctgaagctcctgaccgacttccagccccaccagctgtggaccacgctcctgtccctgaccttcatccgcaccagcctctccctggactacgcctggaagaccatggcgatggccctgagcatcgtgtccctcttccccctgtgcctgagcacgacctcccagaagaccacctggctcccggtgctgctgggcagcttcgggtgcaagcccctcacgatgttcctgatcaccgagaacaagatctggggccggaagtcctggcccatcaacgaggggatcatggccgtcggcatcgtgagcatcctgctctccagcctgctgaagaacgacgtgcccctcgccgggccgctgatcgcgggcggcatgctgatcgcctgctacgtcatcagcgggtccagcgccgacctctccctggagaaggccgccgaggtgagctgggaggaggaggcggagcactccggcaccagccacaacatcctggtggaggtccaggacgacgggaccatgaagatcaaggacgaggagcgcgacgacaccctcacgatcctgctgaaggccaccctcctggccgtgtccggcgtgtaccccatgagcatccccgccaccctgttcgtctggtacttctggcagaagaagaagcagcggtccggggtgctgtgggacacccccagcccgcccgaggtggagcgcgccgtcctcgacgacggcatctaccggatcctgcagcgcggcctgctcgggcggtcccaggtgggcgtgggggtcttccaggacggcgtgttccacacgatgtggcacgtgacccgcggggcggtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacgcccggcaccttcaagacccccgagggcgaggtcggggccatcgccctggacttcaagcccggcaccagcgggtccccgatcgtgaaccgggagggcaagatcgtgggcctgtacgggaacggcgtcgtgacgaccagcgggacctacgtgtccgcgatcgcccaggccaaggccacccaggagggcacgctccccgagatcgaggacgaggtcttcaagaagcgcaacctgaccatcatggacctgcaccccgggagcggcaagacccggcgctacctcccggccatcgtgcgggaggcgatcaagcgcaagctgcggaccctgatcctcgcccccacgcgcgtggtcgccagcgagatggccgaggcgctgaagggcatgcccatccgctaccagaccaccgccgtgaagtccgagcacaccgggcgggagatcgtggacctgatgtgccacgccacgttcaccatgcgcctcctgagccccgtccgggtgccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccgcagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctctcccgcaagacgttcgacaccgagtaccagaagaccaagaacaacgactgggactacgtggtcaccacggacatcagcgagatgggggccaacttccgggcggaccgcgtgatcgacccgcggcgctgcctgaagcccgtgatcctgaaggagggccccgagcgggtcatcctcgccgggcccatgccggtgaccgtcgcctccgccgcgcagcgccggggccgcatcggccggaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgccctgcgcgagttcaaggagttcgcggccgggcggcgctccgtcagcggcgacctgatcctcgagatcggcaagctgccgcagcacctgaccctccgggcccagaacgccctggacaacctggtgatgctccacaacagcgagcagggcgggaaggcctaccgccacgcgatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcctccagcgcgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgcggccaacgagatggggctgctggagaccaccaagaaggacctcggcatcgggcacgtggccgtggagaaccaccaccacgccacgatgctggacgtcgacctgcggcccgcctccgcgtggaccctctacgccgtggccaccaccgtgatcacgccgatgatgcgccacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgggaggcccagaagcgcacggccgccgggatcatgaagaaccccaccgtggacggcatcgtgaccatcgacctcgaccccgtcgtgtacgacgccaagttcgagaagcagctgggccagatcatgctgctcatcctgtgcacctcccagatcctgctcatgcgcacgacctgggcgctgtgcgagagcatcaccctggccaccgggcccctcacgaccctgtgggagggctccccggggaagttctggaacaccaccatcgccgtgagcatggccaacatcttccggggctcctacctggccggcgcggggctcgccttcagcctgatgaagtccctgggcgggggccgccgggggacgggcgcccagggcgagaccctcggggagaagtggaagcgccagctgaaccagctgagcaagtccgagttcaacacctacaagaagtccggcatcatggaggtcgaccggagcgaggccaaggaggggctgaagcgcggcgagaccacgaagcacgccgtgtcccgggggaccgcgaagctccgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacctggtgaagctgcactccgggaaggacgtgttcttcacgccgcccgagaagtgcgacaccctcctgtgcgacatcggcgagagctcccccaacccgaccatcgaggaggggcggaccctgcgcgtcctcaagatggtggagccctggctgcggggcaaccagttctgcatcaagatcctgaacccctacatgcccagcgtggtcgagacgctcgagcagatgcagcgcaagcacggcgggatgctggtgcggaacccgctgtcccgcaacagcacccacgagatgtactgggtgtcctgcggcaccgggaacatcgtcagcgccgtgaacatgacctcccggatgctcctgaaccgcttcacgatggcgcaccggaagcccacctacgagcgcgacgtggacctgggcgccggcacccgccacgtcgccgtggagcccgaggtggccaacctcgacatcatcgggcagcggatcgagaacatcaagaacgagcacaagagcacctggcactacgacgaggacaacccctacaagacgtgggcctaccacggctcctacgaggtcaagccgagcgggtccgcgagctccatggtgaacggcgtcgtgcgcctgctgaccaagccctgggacgtgatccccatggtcacccagatcgccatgaccgacacgacccccttcgggcagcagcgggtgttcaaggagaaggtggacacccgcaccccgcgggccaagcgcggcacggcccagatcatggaggtcaccgccaagtggctctggggcttcctgagccggaacaagaagccccgcatctgcacccgggaggagttcacccgcaaggtgcggtccaacgcggccatcggggccgtgttcgtcgacgagaaccagtggaacagcgccaaggaggccgtggaggacgagcgcttctgggacctggtgcaccgggagcgcgagctccacaagcagggcaagtgcgcgacgtgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagccggagcacgccctgctggcgacctccatcttcaagctcacctaccagaacaaggtggtccgggtgcagcgccccgccaagagcggcaccgtgatggacgtcatctcccgccgggaccagcgcgggagcggccaggtgggcacgtacgggctgaacaccttcaccaacatggaggtgcagctgatccggcagatggagtccgagggcatcttcagcccctccgagctcgagacccccaacctggccaagaaggtcctggactggctcgagaagcacggggccgagcgcctgaagcggatggccatcagcggcgacgactgcgtggtgaagccgatcgacgaccgcttcgcgacggccctgaccgccctcaacgacatggggaaggtccggaaggacatcccccagtgggagccctccaagggctggaacgactggcagcaggtccccttctgcagccaccacttccaccagctgatcatgaaggacggccgcgagatcgtggtcccgtgccggaaccaggacgagctggtggggcgcgcccgggtgtcccagggcgccgggtggagcctccgcgagaccgcgtgcctgggcaagtcctacgcccagatgtggcagctgatgtacttccaccggcgcgacctccggctggccgccaacgccatctgcagcgcggtccccgtggactgggtgcccaccagccgcaccacgtggtccatccacgcccaccaccagtggatgaccaccgaggacatgctgagcgtctggaaccgggtgtggatcgaggagaacccctggatggaggacaagacccacgtgtccagctgggaggaggtcccgtacctcgggaagcgcgaggaccagtggtgcggctccctgatcggcctgacggcccgggccacctgggcgaccaacatccaggtggccatcaaccaggtgcgccgcctcatcgggaacgagaactacctggactacatgaccagcatgaagcggttcaagaacgagtccgaccccgagggcgccctgtggtga

SEQ ID NO: 8808 - RNA, 9879 nt, synthetic construct
  misc_feature 1..9879: note = derived and/or modified CDS sequence (opt1) from DENV-1__KP723473__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagtgcgacagccggtggctggacgcccgcacctacagcgaccccctggcgctccgggagttcaaggagttcgccgccgggcgccggtccgtgagcggcgacctgatcctggagatcggcaagctcccccagcacctgaccctgcgcgcccagaacgccctcgacaacctggtgatgctgcacaactccgagcagggcgggaaggcgtaccggcacgccatggaggagctcccggacaccatcgagacgctgatgctgctcgccctgatcgccgtcctgaccgggggcgtgaccctcttcttcctgagcgggaagggcctgggcaagacctccatcgggctcctgtgcgtgatggcgagctccgtcctgctctggatggccagcgtggagccccactggatcgccgcctccatcatcctggagttcttcctgatggtgctcctgatccccgagcccgaccgccagcggacgccgcaggacaaccagctggcctacgtcgtgatcggcctcctgttcatgatcctgaccgtggcggccaacgagatggggctcctggagaccaccaagaaggacctgggcatcgggcacgtcgtggccgagaaccaccaccacgccacgatgctcgacatcgacctgcaccccgccagcgcgtggaccctgtacgccgtggccaccaccatcatcacgcccatgatgcgccacaccatcgagaacaccaccgccaacatctccctcacggccatcgcgaaccaggccgccatcctgatgggcctggacaagggctggccgatcagcaagatggacatcggggtccccctcctggccctgggctgctactcccaggtgaaccccctcaccctgaccgccgcggtgctgatgctcgtcgcccactacgccatcatcgggcccggcctgcaggccaaggcgacccgggaggcccagaagcgcacggccgccgggatcatgaagaacccgaccgtggacggcatcgtggccatcgacctggaccccgtcgtgtacgacgcgaagttcgagaagcagctcggccagatcatgctgctgatcctctgcaccagccagatcctgctgatgcgcaccacgtgggccctctgcgagtccatcaccctggccaccgggcccctgaccacgctctgggagggcagccccgggaagttctggaacaccaccatcgccgtgtccatggccaacatcttccggggcagctacctggcgggcgccgggctggccttctccctcatgaagtccctgggcgggggccgccgggggaccggcgcccagggcgagacgctgggggagaagtggaagcgccagctcaaccagctgagcaagtccgagttcaacacctacaagcggagcggcatcatggaggtcgaccgctccgaggccaaggaggggctgaagcggggcgagaccaccaagcacgcggtgagccgcgggacggccaagctccggtggttcgtggagcgcaacctggtcaagccggagggcaaggtgatcgacctgggctgcgggcggggcgggtggtcctactactgcgccggcctgaagaaggtgaccgaggtcaaggggtacaccaagggcggccccgggcacgaggagcccatccccatggccacctacggctggaacatcgtgaagctccacagcgggcgcgacgtgttcttcaccccgcccgagaagtgcgacacgctgctgtgcgacatcggcgagtccagccccaaccccaccatcgaggaggggcggaccctccgcgtcctgaagatggtggagccgtggctgcggggcatccagttctgcatcaagatcctcaacccctacatgccctccgtggtcgagaccctggagcagatgcagcgcaagcacggcgggatgctggtgcggaaccccctcagccgcaactccacgcacgagatgtactgggtgagctgcggcaccgggaacatcgtctccgcggtgaacatgaccagccggatgctgctgaaccgcttcaccatggcccaccgcaagccgacgtacgagcgggacgtggacctcggcgccggcacccgccacgtcgccgtggagcccgagatcgccaacctggacatcatcgggcagcggatcgagaacatcaagaacgagcacaagtccacctggcactacgacgaggacaacccctacaagacctgggcgtaccacggcagctacgaggtgaagccctccgggacggccagctccatggtcaacggcgtggtccgcctgctcaccaagccgtgggacgtgatccccatggtgacccagatcgccatgaccgacacgacccccttcgggcagcagcgggtcttcaaggagaaggtggacacccgcacgccccggccgaagcgcggcacggcccagatcatggaggtgaccgccaagtggctgtggggcttcctgagccggaacaagaagccccgcatctgcacccgggaggagttcacccgcaaggtccggagcaacgcggccatcggggccgtgttcgtggacgagaaccagtggaactccgccaaggaggccgtcgaggacgagcgcttctgggacctcgtgcaccgggagcgcgagctgcacaagcagggcaagtgcgcgacgtgcgtgtacaacatgatggggaagcgggagaagaagctgggcgagttcgggaaggccaagggcagccgcgccatctggtacatgtggctcggcgcccggttcctggagttcgaggcgctggggttcatgaacgaggaccactggttctcccgcgagaacagcctctccggcgtcgagggggagggcctgcacaagctggggtacatcctccgggacatcagcaagatccccggcggcaacatgtacgccgacgacaccgccgggtgggacacccgcatcaccgaggacgacctgcagaacgaggccaagatcacggacatcatggagccggagcacgccctgctcgcgacctccatcttcaagctgacctaccagaacaaggtggtgcgcgtccagcggcccgccaagagcggcaccgtgatggacgtgatctcccgccgggaccagcgcgggagcggccaggtcggcacgtacgggctgaacaccttcaccaacatggaggtgcagctcatccggcagatggagtccgagggcatcttcagcccctccgagctggagaacagcaacctggccgagcgcgtgctcgactggctggagaagcacggggtcgagcggctgaagcgcatggccatctccggcgacgactgcgtggtgaagcccaccgacgaccggttcgccacggcgctcaccgccctgaacgacatggggaaggtccgcaaggacatcccgcagtgggagcccagcaagggctggaacgactggcagcaggtccccttctgctcccaccacttccaccagctgatcatgaaggacggccgggagatcgtggtcccctgccgcaaccaggacgagctcgtggggcgggcccgcgtgagccagggcgccgggtggagcctgcgggagaccgcctgcctgggcaagtcctacgcgcagatgtggcagctcatgtacttccaccgccgggacctgcgcctggccgccaacgccatctgcagcgccgtcccggtgaactgggtgcccacctcccggaccacgtggagcatccacgcgcaccaccagtggatgaccaccgaggacatgctctccgtctggaaccgcgtgtggatcgaggagaacccctggatggaggacaagacccacgtgagctcctgggaggacgtcccctacctggggaagcgcgaggaccagtggtgcggcagcctgatcggcctcacggcccgggccacctgggccaccaacatccaggtggcgatcaaccaggtgcgccggctgatcgggaacgagaactacctggactacatgacctccatgaagcgcttcaagaacgagagcgacccggagggcgccctctggtga

SEQ ID NO: 8809 - RNA, 9879 nt, synthetic construct
  misc_feature 1..9879: note = derived and/or modified CDS sequence (opt1) from DENV-1__KT187564__SS-prME
  source 1..9879: mol_type = other RNA
agcgtgaccatgctgctcatgctgatgcccaccgccctggccttccacctcaccacccggggcggggagccccacatgatggtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggggaagtcctggctcgtgcacaagcagtggttcctggacctgcccctcccctggaccagcggcgccagcacctcccaggagacgtggaaccggcaggacctgctggtgaccttcaagaccgcccacgcgaagaagcaggaggtcgtggtgctcggcagccaggagggggccatgcacaccgccctgacgggcgccaccgagatccagacctccgggaccacgaccatcttcgccggccacctgaagtgccgcctcaagatggacaagctgaccctgaaggggatgagctacgtcatgtgcaccggctccttcaagctcgagaaggaggtggcggagacgcagcacggcaccgtgctggtccagatcaagtacgaggggaccgacgccccctgcaagatccccttcagcacccaggacgagaagggcgtgacgcagaacgggcggctgatcaccgccaacccgatcgtgaccgacaaggagaagcccgtcaacatcgaggccgagccgcccttcggcgagtcctacatcgtgatcggcgcgggggagaaggccctgaagctcagctggttcaagaagggctccagcatcgggaagatgttcgaggccaccgcccgcggcgcccggcgcatggcgatcctgggggacacggcctgggacttcggctccatcggcggggtgttcaccagcgtcggcaagctggtgcaccagatcttcgggaccgcctacggcgtcctcttctccggggtcagctggaccatgaagatcggcatcggcgtgctgctgacgtggctcgggctgaactcccgcagcacctccctgagcatgacctgcatcgccgtgggcctcgtcaccctgtacctgggggtgatggtgcaggccgactccggctgcgtcatcaactggaaggggcgggagctcaagtgcggcagcggcatcttcgtgacgaacgaggtgcacacctggaccgagcagtacaagttccaggcggacagcccgaagcgcctgtccgccgccatcgggaaggcctgggaggagggcgtctgcgggatccggagcgccacccgcctggagaacatcatgtggaagcagatctccaacgagctcaaccacatcctgctggagaacgacatgaagttcaccgtggtggtcggcgacgtggcggggatcctcgcccagggcaagaagatgatccggccccagcccatggagtacaagtacagctggaagtcctggggcaaggccaagatcatcggggccgacgtgcagaacacgaccttcatcatcgacggccccaacaccccggagtgccccgacgaccagcgcgcgtggaacatctgggaggtcgaggactacgggttcggcatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggggtgctcgagtccgagatgatcatccccaagatctacggcgggccgatcagccagcacaactaccgccccggctacttcacccagaccgccgggccctggcacctgggcaagctggagctcgacttcgacctgtgcgagggcaccacggtggtcgtggacgagcactgcgggaaccggggcccgtccctgcgcaccaccaccgtgacggggaagatcatccacgagtggtgctgccggagctgcaccctgccgcccctccgcttccggggcgaggacgggtgctggtacggcatggagatccgccccgtcaaggagaaggaggagaacctggtgaagtccatggtgagcgccggcagcggggaggtcgactccttcagcctcggcctgctgtgcatctccatcatgatcgaggaggtgatgcggagccgctggtcccggaagatgctcatgatcgggaccctggccgtgttcttcctgctcatcatgggccagctgacctggaacgacctgatccgcctctgcatcatggtcggggcgaacgccagcgaccgcatgggcatgggcacgacctacctggccctgatggccaccttcaagatgcggccgatgttcgccgtggggctcctgttccgccggctgacctcccgcgaggtgctcctgctgacgatcggcctcagcctggtcgcgtccgccgagctgcccaacagcctcgaggagctgggggacggcctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctggggagcctcggctgcaagccgctgaccatgttcctgatcgccgagaacaagatctgggggcggaagtcctggcccctcaacgagggcatcatggccgtggggatcgtcagcatcctgctgagctccctcctgaagaacgacgtgcccctggccggccccctcatcgcgggcgggatgctgatcgcctgctacgtgatcagcggctccagcgccgacctgtccctcgagaaggccgccgaggtcagctgggaggaggaggcggagcactccggggccagccacaacatcctggtggaggtgcaggacgacggcacgatgaagatcaaggacgaggagcgcgacgacaccctgaccatcctcctgaaggccaccctgctcgccgtctccggggtgttcccgctgagcatccccgccaccctgttcgtgtggtacttctggcagaagaagaagcagcggtccggcgtcctctgggacacgcccagcccgcccgaggtggagcgcgcggtgctggacgacggcatctaccggatcatgcagcgcgggctgctgggccggtcccaggtcggggtgggcgtgttccaggagaacgtcttccacaccatgtggcacgtgacccgcggggccgtgctcatgtaccagggcaagcggctggagcccagctgggcctccgtcaagaaggacctgatcagctacggcgggggctggcgcctccaggggtcctggaacaccggcgaggaggtccaggtgatcgccgtcgagcccgggaagaaccccaagaacgtgcagacggcccccggcaccttcaagacccccgagggcgaggtgggggcgatcgccctggacttcaagcccggcaccagcgggtcccccatcgtcaaccgggagggcaagatcgtgggcctgtacgggaacggcgtggtcacgaccagcgggacctacgtgagcgccatcgcccaggcgaaggcctcccaggagggcccgctccccgagatcgaggacgaggtgttccgcaagcggaacctgaccatcatggacctgcaccccgggagcggcaagacgcgccggtacctcccggccatcgtccgcgaggccatcaagcggaagctgcgcaccctgatcctcgcccccacccgcgtggtggcgtccgagatggccgaggccctgaagggcatgcccatccggtaccagaccacggccgtcaagagcgagcacaccgggaaggagatcgtggacctgatgtgccacgccaccttcaccatgcgcctcctgtcccccgtgcgggtcccgaactacaacatgatcatcatggacgaggcgcacttcacggaccccagctccatcgccgcccgcggctacatcagcacccgggtggggatgggcgaggccgccgcgatcttcatgaccgccacgccgcccgggtccgtggaggccttcccgcagagcaacgccgtcatccaggacgaggagcgcgacatccccgagcggtcctggaacagcggctacgagtggatcacggacttccccggcaagaccgtgtggttcgtgccctccatcaagagcgggaacgacatcgcgaactgcctgcgcaagaacggcaagcgggtcatccagctctcccgcaagaccttcgacaccgagtaccagaagacgaagaacaacgactgggactacgtggtgaccaccgacatcagcgagatgggggccaacttccgggccgaccgcgtcatcgacccgcggcgctgcctgaagcccgtgatcctgaaggacggccccgagcgggtgatcctcgccgggcccatgccggtcaccgtggcctccgcggcccagcgccggggccgcatcggccggaaccacaacaaggagggggaccagtacatctacatgggccagcccctgaacaacgacgaggaccacgcccactggacggaggccaagatgctgctcgacaacatcaacacccccgaggggatcatccccgccctgttcgagccggagcgcgagaagtccgcggccatcgacggcgagtaccgcctgcgcggggaggcccgcaagaccttcgtcgagctcatgcggcgcggcgacctgcccgtgtggctgtcctacaaggtggccagcgagggcttccagtacagcgaccggcgctggtgcttcgacggggagcggaacaaccaggtcctcgaggagaacatggacgtggagatctggaccaaggagggcgagcgcaagaagctgcggccccgctggctggacgcccggacgtactccgaccccctcgcgctgcgcgagttcaaggagttcgccgccgggcggcgcagcgtgtccggcgacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgaccggcggggtgaccctcttcttcctgtccgggcgcgggctgggcaagaccagcatcgggctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcggcctcctgttcatgatcctgaccgtcgcggccaacgagatggggctcctggagacgaccaagaaggacctgggcatcgggcacgtggccgtggagaaccaccaccacgccgccatgctcgacgtcgacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatgggcctggacaagggctggcccatctccaagatggacatcggggtgcccctcctggcgctgggctgctacagccaggtcaaccccctcaccctgaccgccgccgtgctgatgctcgtggcccactacgccatcatcgggccgggcctgcaggcgaaggccacgcgcgaggcccagaagcgcaccgccgccgggatcatgaagaaccccaccgtcgacggcatcgtggcgatcgacctggaccccgtggtctacgacgccaagttcgagaagcagctcggccagatcatgctgctgatcctctgcacctcccagatcctgctgatgcggacgacctgggccctctgcgagagcatcaccctggccaccgggcccctgacgaccctctgggagggctccccggggaagttctggaacaccaccatcgccgtgagcatggcgaacatcttccgcggctcctacctggccggcgccgggctggccttcagcctcatgaagtccctgggcgggggccggcgcgggacgggcgcgcagggcgagaccctgggggagaagtggaagcggcgcctcaaccagctgtccaagagcgagttcaacacctacaagcggtccggcatcatggaggtggaccgcagcgaggccaaggaggggctgaagcggggcgagaccacgaagcacgccgtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagcccatcccgatggcgacgtacggctggaacctcgtcaagctgcactccgggaaggacgtgttcttcatcccgcccgagaagtgcgacaccctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagacgctggagcagatgcagcggaagcacggcgggatgctcgtccgcaacccgctgtcccggaacagcacccacgagatgtactgggtgtcctgcggcaccgggaacatcgtgagcgccgtcaacatgacctcccgcatgctgctcaaccgcttcaccatggcccaccggaagcccacgtacgagcgcgacgtggacctgggcgccggcacccggcacgtggccgtcgagcccgaggtggcgaacctggacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctcctgacgaagccctgggacgtgatccccatggtgacccagatcgccatgaccgacaccacgcccttcgggcagcagcgggtcttcaaggagaaggtggacacccgcaccccgaaggccaagcggggcaccgcgcagatcatggaggtgacggcccgctggctgtggggcttcctctcccggaacaagaagccccgcatctgcacccgggaggagttcacccgcaaggtccggagcaacgccgccatcggggcggtgttcatcgacgagaaccagtggaactccgccaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacacggccgggtgggacacccgcatcaccgaggacgacctgcagaacgaggcgaagatcaccgacatcatggagccggagcacgccctcctggccaaggccatcttcaagctgacgtaccagaacaaggtcgtgcgcgtgcagcggcccgccaagaacggcaccgtcatggacgtgatctcccgccgggaccagcgcgggagcggccaggtgggcacctacgggctcaacaccttcacgaacatggaggcgcagctgatccggcagatggagtccgagggcatcttcagcccctccgagctggagacccccaacctcgccgagcgcgtcctggactggctggggaagtacggcgtggagcggctcaagcgcatggccatcagcggggacgactgcgtggtcaagccgatcgacgaccggttcgccaccgccctgaccgcgctgaacgacatgggcaaggtgcgcaaggacatcccccagtgggagccctccaagggctggaacgactggcagcaggtccccttctgcagccaccacttccaccagctcatcatgaaggacgggcgggagatcgtcgtgccgtgccgcaaccaggacgagctggtgggccgggcccgcgtctcccagggggccggctggagcctgcgggagacggcctgcctcggcaagagctacgcgcagatgtggcagctgatgtacttccaccgccgggacctgcgcctcgccgccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacatctccaactgggaggacgtcccgtacctgggcaagcgcgaggaccagtggtgcggcagcctcatcgggctgaccgcccgggccacgtgggccaccaacatccaggtggccatcaaccaggtgcgccggctgatcggcaacgagaactacctcgactacatgacctccatgaagcgcttcaagaacgagagcgaccccgagggggcgctgtggtga

SEQ ID NO: 8810 - RNA, 9879 nt, synthetic construct
  misc_feature 1..9879: note = derived and/or modified CDS sequence (opt1) from DENV-1__KT187560__SS-prME
  source 1..9879: mol_type = other RNA
agcgtgaccatgctgctcatgctgctgcccaccgccctcgccttccacctgacgacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccctggggtgcaagccgctcaccatgttcctgatcaccgagaacaagatctggggccgcaagagctggcccctgaacgaggggatcatggccgtgggcatcgtctccatcctcctgagcagcctgctcaagaacgacgtgcccctggccgggcccctgatcgccggcggcatgctcatcgcgtgctacgtgatctccgggagctccgccgacctgagcctggagcgcgccgccgaggtctcctgggaggaggaggccgagcacagcggcgcgtcccacaacatcctcgtggaggtgcaggacgacgggacgatgaagatcaaggacgaggagcgggacgacaccctgaccatcctgctcaaggccaccctgctggccgtcagcggcgtgtacccgatgtccatccccgccaccctcttcgtgtggtacttctggcagaagaagaagcagcgcagcggggtcctgtgggacacccccagcccgcccgaggtggagcgggccgtgctggacgacggcatctaccgcatcctgcagcggggcctcctggggcgcagccaggtcggcgtgggggtgttccaggacggcgtcttccacaccatgtggcacgtgacccgcggggcggtgctgatgtaccagggcaagcgcctcgagccctcctgggccagcgtcaagaaggacctgatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctctacgggaacggcgtggtcaccacctccgggacgtacgtgagcgcgatcgcccaggccaaggccagccaggagggcccgctgcccgagatcgaggacgaggtgttcaagaagcggaacctgaccatcatggacctccaccccgggtccggcaagacccgccggtacctgccggccatcgtccgcgaggcgatcaagcgcaagctgcggaccctcatcctggcccccacgcgcgtggtggccagcgagatggccgaggcgctgaagggcatgcccatccggtaccagaccaccgccgtcaagtccgagcacaccgggaaggagatcgtggacctcatgtgccacgccacgttcaccatgcgcctgctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctccgcaagaacggcaagcgggtcatccagctgtcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctcaaggacggccccgagcgggtcatcctggccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctcctggacaacatcaacacccccgaggggatcatccccgccctgttcgagccggagcgggagaagtccgcggccatcgacggcgagtaccgcctccgcggggaggcccgcaagacgttcgtggagctgatgcggcgcggcgacctgcccgtctggctctcctacaaggtggccagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcccggacctacagcgaccccctggcgctgcgcgagttcaaggagttcgccgccgggcggcgcagcgtgtccggcgacctcatcctggagatcggcaagctgccgcagcacctcaccctgcgggcccagaacgccctggacaacctcgtgatgctgcacaacagcgagcagggcgggaaggcgtaccgccacgccatggaggagctgcccgacaccatcgagacgctcatgctgctggccctcatcgccgtcctgaccgggggcgtgaccctgttcttcctctccgggaagggcctgggcaagaccagcatcgggctgctctgcgtgatggcgtccagcgtcctgctgtggatggcctccgtggagccccactggatcgccgccagcatcatcctcgagttcttcctgatggtgctgctcatccccgagccggaccggcagcgcacgccccaggacaaccagctggcctacgtcgtgatcggcctcctcttcatgatcctgaccgtggcggccaacgagatggggctgctcgagaccaccaagaaggacctgggcatcgggcacgtcgtggccgagaaccaccaccacgccacgatgctggacatcgacctccaccccgcctccgcgtggaccctgtacgccgtggccaccaccatcatcacgccgatgatgcggcacaccatcgagaacaccaccgccaacatcagcctgacggccatcgcgaaccaggccgccatcctcatgggcctggacaagggctggcccatctccaagatggacatcggggtccccctgctcgccctgggctgctacagccaggtgaaccccctgaccctcaccgccgcggtgctgatgctggtcgcccactacgccatcatcgggccgggcctccaggccaaggcgacccgcgaggcccagaagcgcacggccgccgggatcatgaagaaccccaccgtggacggcatcgtggccatcgacctggaccccgtcgtgtacgacgcgaagttcgagaagcagctgggccagatcatgctcctgatcctgtgcacctcccagatcctcctgatgcggaccacgtgggccctgtgcgagagcatcaccctcgccaccgggcccctgaccacgctgtgggagggctccccggggaagttctggaacaccaccatcgccgtgagcatggccaacatcttccgcggctcctacctcgcgggcgccgggctggccttcagcctgatgaagtccctcggcgggggccggcgcgggaccggcgcccagggcgagacgctgggggagaagtggaagcggcagctgaaccagctcagcaagagcgagttcaacacctacaagcgctccggcatcatggaggtcgaccggagcgaggccaaggaggggctgaagcgcggcgagaccaccaagcacgcggtgtcccgggggacggccaagctgcgctggttcgtggagcggaacctggtcaagcccgagggcaaggtgatcgacctcggctgcgggcgcggcgggtggagctactactgcgccggcctgaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacacgctcctgtgcgacatcggcgagagctcccccaacccgaccatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacgcacgagatgtactgggtgtcctgcggcaccgggaacatcgtcagcgcggtgaacatgacctcccgcatgctcctgaaccgcttcaccatggcccaccggaagcccacgtacgagcgcgacgtggacctgggcgccggcacccggcacgtcgccgtggagcccgagatcgccaacctcgacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctgctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctctggggcttcctgagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtcgagggggagggcctccacaagctggggtacatcctgcgcgacatcagcaagatcccgggcggcaacatgtacgccgacgacacggccgggtgggacacccgcatcaccgaggacgacctccagaacgaggccaagatcaccgacatcatggagcccgagcacgccctgctggcgacgtccatcttcaagctcacctaccagaacaaggtggtgcgggtccagcgccccgccaagagcggcaccgtgatggacgtgatctcccggcgcgaccagcgggggagcggccaggtcggcacctacgggctgaacacgttcaccaacatggaggtgcagctgatccgccagatggagtccgagggcatcttcagcccctccgagctcgagaacagcaacctggccgagcgggtgctggactggctcgagaagcacggggtcgagcgcctgaagcggatggccatctccggcgacgactgcgtggtgaagccgaccgacgaccgcttcgccaccgcgctgacggccctcaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctggtggggcgcgcccgggtgagccagggcgccgggtggagcctccgcgagaccgcctgcctgggcaagtcctacgcgcagatgtggcagctgatgtacttccaccggcgcgacctccggctggccgccaacgccatctgcagcgccgtccccgtgaactgggtgcccacctcccgcaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctcgggaagcgggaggaccagtggtgcggcagcctgatcggcctgaccgcccgcgccacgtgggccaccaacatccaggtggcgatcaaccaggtgcggcgcctcatcgggaacgagaactacctggactacatgacctccatgaagcggttcaagaacgagagcgaccccgagggcgccctgtggtga

SEQ ID NO: 8811 - RNA, 9879 nt, synthetic construct
  misc_feature 1..9879: note = derived and/or modified CDS sequence (opt1) from DENV-1__KT187561__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgccccacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctgatcacggccaacccgatcgtgaccgacaaggagaagcccgtgaacatcgagaccgagccgcccttcggggagagctacatcgtcatcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctgcgggactcctacacccagatgtgcgaccaccgcctcatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctgtggtccaacggcgtgctcgagagcgagatgatcatccccaagatctacgggggcccgatctcccagcacaactaccggcccgggtacttcacccagacggcgggcccctggcacctggggaagctggagctcgacttcaacctgtgcgagggcaccaccgtggtcgtggacgagcactgcggcaaccgcgggccgagcctgcggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctggtgcgcagcatggtgtccgccggcagcggcgaggtcgacagcttctccctcgggctgctgtgcgtgagcatcatgatcgaggaggtgatgcggtcccgctggagccgcaagatgctcatgacgggcaccctggccgtcttcttcctgctcatcatggggcagctgacctggaacgacctgatccggctctgcatcatggtgggcgccaacgtgtccgaccgcatggggatgggcaccacgtacctggccctgatggcgaccttcaagatgcggccgatgttcgccgtcggcctcctgttccgccggctgaccagccgcgaggtgctcctgctgaccatcgggctctccctggtcgccagcgtggagctgcccaactccctcgaggagctgggcgacgggctggccatgggcatcatgatgctcaagctgctgacggacttccagagccaccagctctggaccaccctgctgtccctcaccttcatcaagacgaccctgagcctggactacgcctggaagaccatggcgatggtgctctccatcgtcagcctgttccccctgtgcctctccaccacgagccagaagaccacctggctgcccgtgctgctcggctccttcgggtgcaagccgctgaccatgttcctgatcaccgagaacaagatctggggccgcaagagctggcccctcaacgaggggatcatggccgtgggcatcgtctccatcctgctgagcagcctcctgaagaacgacgtgcccctggccgggcccctcatcgccggcggcatgctgatcgcgtgctacgtgatctccgggagctccgccgacctgagcctcgagcgcgccgccgaggtctcctgggaggaggaggccgagcacagcggcgcgtcccacaacatcctggtggaggtgcaggacgacgggacgatgaagatcaaggacgaggagcgggacgacaccctgaccatcctcctgaaggccaccctgctcgccgtcagcggcgtgtacccgatgtccatccccgccacgctgttcgtgtggtacttctggcagaagaagaagcagcgcagcggggtcctgtgggacacccccagcccgcccgaggtggagcgggccgtgctcgacgacggcatctaccgcatcctgcagcggggcctgctggggcgcagccaggtcggcgtgggggtgttccaggacggcgtcttccacaccatgtggcacgtgacccgcggggcggtgctcatgtaccagggcaagcgcctggagccctcctgggccagcgtcaagaaggacctgatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctcgacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctgcccgagatcgaggacgaggtgttcaagaagcggaacctcaccatcatggacctgcaccccgggtccggcaagacccgccggtacctgccggccatcgtccgcgaggcgatcaagcgcaagctccggaccctgatcctggcccccacgcgcgtggtggccagcgagatggccgaggcgctcaagggcatgcccatccggtaccagaccaccgccgtcaagtccgagcacaccgggaaggagatcgtggacctgatgtgccacgccacgttcaccatgcgcctgctcagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctgtcccgcaagacgttcgacaccgagtaccagaagaccaagaacaacgactgggactacgtggtgaccacggacatcagcgagatgggggccaacttccgggcggaccgcgtcatcgacccgcggcgctgcctcaagcccgtgatcctgaaggacggccccgagcgggtcatcctggccgggcccatgccggtgaccgccgcctccgcggcccagcgccggggccgcatcggccgcaaccagaacaaggagggggaccagtacatctacatgggccagcccctcaacaacgacgaggaccacgcccactggaccgaggccaagatgctgctggacaacatcaacacccccgaggggatcatccccgccctcttcgagccggagcgggagaagtccgcggccatcgacggcgagtaccgcctgcgcggggaggcccgcaagacgttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagggcgagcgcaagaagctccggccccgctggctggacgcccggacctacagcgaccccctggcgctccgcgagttcaaggagttcgccgccgggcggcgcagcgtgtccggcgacctgatcctggagatcggcaagctcccgcagcacctgaccctgcgggcccagaacgccctcgacaacctggtgatgctgcacaacagcgagcagggcgggaaggcgtaccgccacgccatggaggagctccccgacaccatcgagacgctgatgctgctcgccctgatcgccgtcctgaccgggggcgtgaccctcttcttcctgtccgggaagggcctgggcaagaccagcatcgggctcctgtgcgtgatggcgtccagcgtcctgctctggatggcctccgtggagccccactggatcgccgccagcatcatcctggagttcttcctgatggtgctcctgatccccgagccggaccggcagcgcacgccccaggacaaccagctggcctacgtcgtgatcggcctcctgttcctgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgcggtgtcccgggggacggccaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacgcacgagatgtactgggtgtcctgcggcaccgggaacatcgtcagcgcggtgaacatgacctcccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgcagcaacgcggccatcggggccgtgttcgtggacgagaaccagtggaactccgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtcgagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtgcgggtccagcgccccgccaagagcggcaccgtgatggacgtgatctcccggcgcgaccagcgggggagcggccaggtcggcacctacgggctcaacacgttcaccaacatggaggtgcagctgatccgccagatggagtccgagggcatcttcagcccctccgagctggagaacagcaacctcgccgagcgggtgctggactggctggagaagcacggggtcgagcgcctcaagcggatggccatctccggcgacgactgcgtggtgaagccgaccgacgaccgcttcgccaccgcgctgacggccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgccgtccccgtgaactgggtgcccacctcccgcaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgaccgcccgcgccacgtgggccaccaacatccaggtggcgatcaaccaggtgcggcgcctgatcgggaacgagaactacctcgactacatgacctccatgaagcggttcaagaacgagagcgaccccgagggcgccctgtggtga

SEQ ID NO: 8812 - RNA, 9879 nt, synthetic construct
  misc_feature 1..9879: note = derived and/or modified CDS sequence (opt1) from DENV-1__KT187562__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaagaccctgaagctgtcctggttcaagaaggggagctccatcggcaagatgttcgaggcgacggcccgcggggcccggcgcatggccatcctcggcgacaccgcctgggacttcgggagcatcggcggcgtgttcacctccgtggggaagctggtccaccaggtgttcggcaccgcgtacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgggagctgaagtgcgggtccggcatcttcgtcaccaacgaggtgcacacctggaccgagcagtacaagttccaggccgacagcccgaagcgcctgagcgccgcgatcggcaaggcctgggaggagggggtgtgcggcatccggtccgccacccgcctcgagaacatcatgtggaagcagatcagcaacgagctgaaccacatcctgctcgagaacgacatgaagttcacggtcgtggtgggggacgccaacggcatcctgacccaggggaagaagatgatccggccccagcccatggagcacaagtactcctggaagtcctggggcaaggccaagatcatcggcgcggacacccagaacaccacgttcatcatcgacgggcccgacaccccggagtgccccgacgaccagcgcgcctggaacatctgggaggtcgaggactacggcttcggggtgttcaccaccaacatctggctgaagctccgggactcctacacgcagatgtgcgaccaccgcctgatgagcgccgccatcaaggactccaaggcggtgcacgccgacatgggctactggatcgagagcgagaagaacgagacctggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcaacctgtgcgagggcaccaccgtggtcgtggacgagcactgcggcaaccgcgggccgagcctccggacgaccaccgtgaccggcaagatcatccacgagtggtgctgccgctcctgcacgctgccgcccctgcggttccgcggggaggacggctgctggtacgggatggagatccggcccgtcaaggagaaggaggagaacctcgtgcgcagcatggtgtccgcgggcagcggcgaggtcgacagcttctccctggggctgctctgcgtgagcatcatgatcgaggaggtgatgcggtcccgctggagccgcaagatgctgatgaccggcaccctggccgtcttcttcctcctgatcatggggcagctgacctggaacgacctcatccggctgtgcatcatggtgggcgccaacgtgtccgaccgcatggggatgggcacgacctacctggccctcatggccaccttcaagatgcggccgatgttcgcggtcgggctgctgttccgccggctcaccagccgcgaggtgctgctgctcacgatcgggctgtccctggtcgccagcgtggagctccccaactccctggaggagctgggcgacgggctcgccatgggcatcatgatgctgaagctgctcaccgacttccagagccaccagctgtggaccaccctgctctccctgacgttcatcaagaccaccctgagcctcgactacgcctggaagaccatggccatggtgctgtccatcgtcagcctgttccccctctgcctgtccacgaccagccagaagaccacctggctgcccgtgctcctgggctccttcgggtgcaagccgctgaccatgttcctcatcacggagaacaagatctggggccgcaagagctggcccctgaacgaggggatcatggcggtgggcatcgtctccatcctgctcagcagcctgctgaagaacgacgtgcccctcgccgggcccctgatcgccggcggcatgctgatcgcctgctacgtgatctccgggagctccgcggacctcagcctggagcgcgccgccgaggtctcctgggaggaggaggccgagcacagcggcgcctcccacaacatcctggtggaggtgcaggacgacgggaccatgaagatcaaggacgaggagcgggacgacaccctcaccatcctgctgaaggcgacgctcctggccgtcagcggcgtgtacccgatgtccatccccgccaccctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacgcgcggggccgtgctgatgtaccagggcaagcgcctggagccctcctgggcgagcgtcaagaaggacctcatctcctacggcgggggctggcggttccaggggagctggaacaccggcgaggaggtccaggtgatcgccgtcgagcccgggaagaaccccaagaacgtgcagaccacccccggcacgttcaagacccccgagggcgaggtgggggccatcgccctggacttcaagcccggcacctccgggagccccatcgtcaaccgcgagggcaagatcgtgggcctgtacgggaacggcgtggtcaccacgtccgggacctacgtgagcgccatcgcgcaggccaaggccagccaggagggcccgctccccgagatcgaggacgaggtgttcaagaagcggaacctgaccatcatggacctgcaccccgggtccggcaagacccgccggtacctcccggccatcgtccgcgaggccatcaagcgcaagctgcggacgctgatcctcgcgcccacccgcgtggtggccagcgagatggccgaggccctgaagggcatgcccatccggtaccagaccaccgcggtcaagtccgagcacacggggaaggagatcgtggacctgatgtgccacgccaccttcaccatgcgcctcctgagccccgtgcgggtcccgaactacaacatgatcatcatggacgaggcccacttcaccgaccccgcctccatcgccgcgcgcggctacatcagcacgcgggtggggatgggcgaggccgccgccatcttcatgaccgccacgccgcccgggtccgtggaggcgttcccgcagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctgcgcaagaacggcaagcgggtcatccagctctcccgcaagaccttcgacaccgagtaccagaagaccaagaacaacgactgggactacgtggtgacgaccgacatcagcgagatgggggccaacttccgggccgaccgcgtcatcgacccgcggcgctgcctgaagcccgtgatcctgaaggacggccccgagcgggtcatcctcgcggggcccatgccggtgaccgccgcctccgccgcgcagcgccggggccgcatcggccgcaaccagaacaaggagggggaccagtacatctacatgggccagcccctgaacaacgacgaggaccacgcccactggaccgaggccaagatgctgctcgacaacatcaacacgcccgaggggatcatccccgccctgttcgagccggagcgggagaagtccgccgcgatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgccctgcgcgagttcaaggagttcgcggccgggcggcgcagcgtgtccggcgacctgatcctcgagatcggcaagctgccgcagcacctgaccctccgggcccagaacgccctggacaacctggtgatgctccacaacagcgagcagggcgggaaggcctaccgccacgcgatggaggagctgcccgacacgatcgagaccctgatgctcctggccctgatcgccgtcctcaccgggggcgtgaccctgttcttcctgtccgggaagggcctcggcaagacgagcatcgggctgctgtgcgtgatggcctccagcgtcctcctgtggatggcgtccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggccgcgaacgagatggggctgctggagaccacgaagaaggacctcggcatcgggcacgtcgtggccgagaaccaccaccacgccaccatgctggacatcgacctgcaccccgcctccgcctggaccctctacgcggtggccaccacgatcatcaccccgatgatgcggcacaccatcgagaacaccacggccaacatcagcctgaccgccatcgccaaccaggcggccatcctgatgggcctcgacaagggctggcccatctccaagatggacatcggggtccccctgctggccctcggctgctacagccaggtgaaccccctgaccctgaccgccgccgtgctcatgctggtcgcgcactacgccatcatcgggccgggcctgcaggccaaggccacgcgcgaggcgcagaagcgcaccgccgccgggatcatgaagaaccccaccgtggacggcatcgtggccatcgacctcgaccccgtcgtgtacgacgccaagttcgagaagcagctgggccagatcatgctgctcatcctgtgcacctcccagatcctgctcatgcggacgacctgggcgctgtgcgagagcatcaccctggccaccgggcccctcacgaccctgtgggagggctccccggggaagttctggaacaccaccatcgccgtgagcatggccaacatcttccgcggctcctacctggccggcgcggggctcgccttcagcctgatgaagtccctgggcgggggccggcgcgggacgggcgcccagggcgagaccctcggggagaagtggaagcggcagctgaaccagctgagcaagagcgagttcaacacctacaagcgctccggcatcatggaggtcgaccggagcgaggccaaggaggggctcaagcgcggcgagaccacgaagcacgccgtgtcccgggggaccgcgaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacatcgtgaagctgcactccgggcgggacgtgttcttcacgccgcccgagaagtgcgacaccctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagacgctggagcagatgcagcggaagcacggcgggatgctcgtgcgcaacccgctgtcccggaacagcacccacgagatgtactgggtgtcctgcggcaccgggaacatcgtcagcgccgtgaacatgacctcccgcatgctgctcaaccgcttcacgatggcgcaccggaagcccacctacgagcgcgacgtggacctgggcgccggcacccggcacgtcgccgtggagcccgagatcgccaacctggacatcatcgggcagcgcatcgagaacatcaagaacgagcacaagagcacctggcactacgacgaggacaacccctacaagacgtgggcctaccacggctcctacgaggtgaagccgagcgggtccgcgagctccatggtcaacggcgtggtccggctcctgaccaagccctgggacgtgatccccatggtgacccagatcgccatgaccgacacgacccccttcgggcagcagcgcgtcttcaaggagaaggtggacacccggaccccgcgccccaagcggggcacggcccagatcatggaggtgaccgccaagtggctgtggggcttcctcagccgcaacaagaagccccggatctgcacccgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctgcacaagcagggcaagtgcgccacgtgcgtgtacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgggagaacagcctgtccggcgtcgagggggagggcctgcacaagctcgggtacatcctgcgcgacatcagcaagatcccgggcggcaacatgtacgcggacgacaccgccgggtgggacacccgcatcaccgaggacgacctgcagaacgaggccaagatcacggacatcatggagcccgagcacgccctcctggccacctccatcttcaagctgacctaccagaacaaggtggtgcgggtccagcgccccgccaagagcggcaccgtgatggacgtgatctcccggcgcgaccagcgggggagcggccaggtcggcacgtacgggctcaacaccttcaccaacatggaggtgcagctgatccgccagatggagtccgagggcatcttcagcccctccgagctggagaacagcaacctcgcggagcgggtgctggactggctggagaagcacggggtcgagcgcctcaagcggatggccatctccggcgacgactgcgtggtgaagccgaccgacgaccgcttcgccacggccctgaccgcgctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgccgggtggagcctgcgcgagaccgcctgcctcggcaagtcctacgcccagatgtggcagctgatgtacttccaccggcgcgacctgcggctcgcggccaacgccatctgcagcgccgtccccgtgaactgggtgcccacctcccgcaccacgtggagcatccacgcccaccaccagtggatgaccaccgaggacatgctgtccgtctggaaccgcgtgtggatcgaggagaacccctggatggaggacaagacccacgtgagctcctgggaggacgtcccgtacctggggaagcgggaggaccagtggtgcggcagcctcatcggcctgacggcgcgcgccacctgggccaccaacatccaggtggccatcaaccaggtgcggcgcctgatcgggaacgagaactacctcgactacatgacctccatgaagcggttcaagaacgagagcgaccccgagggcgcgctgtggtga

SEQ ID NO: 8813 - RNA, 9879 nt, synthetic construct
  misc_feature 1..9879: note = derived and/or modified CDS sequence (opt1) from DENV-1__JQ045628__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccttcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccatcctgcggaagctgtgcatcgaggcgaagatctccaacaccacgaccgacagccgctgcccgacccagggcgaggccaccctcgtggaggagcaggacgccaacttcgtgtgccggcgcacgttcgtcgaccggggctgggggaacggctgcgggctgttcggcaaggggtccctgatcacgtgcgccaagttcaagtgcgtgaccaagctcgagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctgaccgactacggggccctcacgctggactgcagcccccgcaccggcctggacttcaacgagatggtgctcctgaccatgaaggagaagtcctggctggtccacaagcagtggttcctcgacctgccgctgccctggaccagcggggccagcacgtcccaggagacctggaaccggcaggacctcctggtgaccttcaagaccgcccacgccaagaagcaggaggtggtcgtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtgatgtgcacggggtccttcaagctggagaaggaggtcgccgagacccagcacggcaccgtgctcgtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctcctgacctggctgggcctcaactcccgcagcacctccctgagcatgacctgcatcgccgtggggctggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcatctggcccaagtcccacaccctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcacgctcgccgtgttcctgctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcgggctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccacccccgggacgttcaagaccctggagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggcccctgccggagatcgaggacgaggtgttccggaagcgcaacctgaccatcatggacctccaccccggcagcgggaagacccggcgctacctgcccgccatcgtccgggaggcgatcaagcgcaagctgcgcacgctcatcctggccccgacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtccccaactacaacatgatcatcatggacgaggcccacttcaccgacccgagctccatcgccgcccgggggtacatcagcacgcgcgtgggcatgggggaggcggccgccatcttcatgaccgccacgccgcccggctccgtggaggccttcccccagagcaacgcggtcatccaggacgaggagcgggacatcccggagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccccgccggtgcctgaagccggtgatcctcaaggacgggcccgagcgcgtgatcctggcgggccccatgcccgtcaccgtggcctccgccgcccagcggcgcgggcggatcggccgcaaccacaacaaggagggcgaccagtacatctacatggggcagccgctgaacaacgacgaggaccacgcccactggaccgaggcgaagatgctcctggacaacatcaacacgcccgagggcatcatccccgccctgttcgagcccgagcgcgagaagtccgccgccatcgacggggagtaccggctccgcggcgaggcccggaagaccttcgtcgagctgatgcgccgcggggacctgccggtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccccagcacctcacgcagcgcgcgcagaacgccctggacaacctggtcatgctccacaacagcgagcagggcgggcgggcctaccgccacgccatggaggagctgccggacaccatcgagaccctgatgctcctggcgctgatcgccgtgctcaccggcggggtgaccctgttcttcctgtccggccgggggctcggcaagacgagcatcggcctgctgtgcgtcatcgcctccagcgtgctcctgtggatggcctccgtggagccccactggatcgccgcgagcatcatcctggagttcttcctcatggtcctgctgatccccgagcccgaccgccagcggaccccgcaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgcccatgatgcgccacaccatcgagaacaccaccgccaacatcagcctgacggccatcgccaaccaggccgcgatcctgatgggcctcgacaagggctggccgatctccaagatggacatcggggtgcccctgctggccctcggctgctacagccaggtcaaccccctgaccctgaccgccgccgtgctcatgctggtggcgcactacgccatcatcgggcccggcctgcaggccaaggccacccgcgaggcccagaagcggacggcggccgggatcatgaagaacccgaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctcccccgggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagccggagggcaaggtcatcgacctgggctgcgggcggggcgggtggagctactactgcgccggcctcaagaaggtgaccgaggtgaaggggtacaccaagggcggccccgggcacgaggagcccatccccatggccacctacggctggaacctggtcaagctgcactccgggaaggacgtgttcttcatcccgcccgagaagtgcgacacgctcctgtgcgacatcggcgagagctcccccaaccccaccatcgaggaggggcgcaccctgcgggtgctcaagatggtcgagccgtggctgcgcggcaaccagttctgcatcaagatcctgaacccctacatgcccagcgtggtggagaccctcgagcagatgcagcggaagcacggcgggatgctggtccgcaaccccctgtcccggaacagcacccacgagatgtactgggtgtcctgcggcacggggaacatcgtgagcgccgtcaacatgacctcccgcatgctcctgaaccgcttcaccatggcccaccggaagccgacctacgagcgcgacgtggacctgggcgcgggcacgcggcacgtggccgtcgagcccgaggtggccaacctcgacatcatcgggcagcgcatcgagaacatcaagcacgagcacaagagcacctggcactacgacgaggacaacccctacaagacctgggcctaccacggctcctacgaggtgaagcccagcgggtccgccagcagcatggtcaacggcgtggtcaagctgctgaccaagccgtgggacgtgatccccatggtgacgcagatcgcgatgaccgacaccacccccttcgggcagcagcgggtcttcaaggagaaggtggacacgcgcacccccaaggccaagcggggcaccgcccagatcatggaggtgaccgccaagtggctctggggcttcctgtcccgcaacaagaagccgcggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagcccgagcacgccctgctggccaagtccatcttcaagctcacctaccagaacaaggtggtgcgcgtccagcggccggcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccaacctggccgagcgcgtgctggactggctcgagaagtacggggtggagcggctgaagcgcatggccatctccggcgacgactgcgtcgtgaagcccatcgacgaccggttcgccaccgcgctgaccgccctcaacgacatggggaaggtgcgcaaggacatcccgcagtgggagcccagcaagggctggaacgactggcagcaggtccccttctgctcccaccacttccaccagctgatcatgaaggacggccgggagatcgtggtgccctgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgccggtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccctacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgacccggagggggccctgtggtga

SEQ ID NO: 8814 - RNA, 9879 nt, synthetic construct
  misc_feature 1..9879: note = derived and/or modified CDS sequence (opt1) from DENV-1__JQ045629__SS-prME
  source 1..9879: mol_type = other RNA
agcgtgaccatgctgctgatgctgatgcccaccgccctggccttccacctcaccacccggggcggggagccccacatgatggtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagccacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagcacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcatcccgcccgagaagtgcgacaccctcctgtgcgacatcggggagagctcccccaacccgacgatcgaggagggccgcaccctgcgggtgctcaagatggtcgagccctggctgcgcgggaaccagttctgcatcaagatcctgaacccctacatgcccagcgtggtggagaccctcgagcagatgcagcggaagcacggcggcatgctggtccgcaacccgctgtcccggaacagcacccacgagatgtactgggtgtcctgcgggaccggcaacatcgtgagcgccgtcaacatgacgtcccgcatgctcctgaaccgcttcaccatggcgcaccggaagcccacctacgagcgcgacgtggacctgggggccggcacccggcacgtggccgtcgagcccgaggtggccaacctcgacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctgaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctctggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgcgacctgcgtgtacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtcgagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctgatccggcagatggagagcgaggggatcttctcccccagcgagctcgagacccccaacctggccgagcgcgtgctggactggctcgagaagtacggcgtggagcggctgaagcgcatggccatctccggggacgactgcgtcgtgaagccgatcgacgaccggttcgcgacggccctgaccgccctcaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctggtcggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtgcccgtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccgtacctcgggaagcgcgaggaccagtggtgcggcagcctgatcggcctgaccgcccgggccacctgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8815 - RNA, 9879 nt, synthetic construct
  misc_feature 1..9879: note = derived and/or modified CDS sequence (opt1) from DENV-1__JQ045630__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccgacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggagaagtcctggctcgtccacaagcagtggttcctggacctgcccctcccctggaccagcggggccagcacgtcccaggagacctggaaccggcaggacctgctggtgaccttcaagaccgcccacgccaagaagcaggaggtggtcgtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtgatgtgcacggggtccttcaagctcgagaaggaggtcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcgggctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccacccccgggacgttcaagacccccgagggcgaggtgggcgccatcgccctggacttcaagcccgggaccagcggctcccccatcgtcaaccgcgaggggaagatcgtgggcctctacggcaacggggtggtcaccacgagcggcacctacgtgagcgccatcgcgcaggccaaggcctcccaggaggggccgctgcccgagatcgaggacgaggtgttccggaagcgcaacctgaccatcatggacctccaccccggcagcgggaagacccggcgctacctgccggccatcgtccgggaggcgatcaagcgcaagctgcgcacgctcatcctggcccccacccgggtggtggcctccgagatggccgaggccctgaagggcatgcccatccgctaccagaccaccgcggtcaagagcgagcacacgggcaaggagatcgtggacctcatgtgccacgccaccttcaccatgcggctgctgtcccccgtgcgcgtcccgaactacaacatgatcatcatggacgaggcccacttcaccgaccccagctccatcgccgcccgggggtacatcagcacgcgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgagtggatcaccgacttccccggcaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgccaacttccgcgccgaccgggtcatcgacccgcgccggtgcctgaagcccgtgatcctcaaggacgggcccgagcgcgtgatcctggcgggccccatgccggtcaccgtggcctccgccgcccagcggcgcgggcggatcggccgcaaccacaacaaggagggcgaccagtacatctacatggggcagcccctgaacaacgacgaggaccacgcccactggaccgaggcgaagatgctcctggacaacatcaacacgcccgagggcatcatccccgccctgttcgagccggagcgcgagaagtccgccgccatcgacggggagtaccggctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacgcagcgcgcgcagaacgccctggacaacctggtcatgctccacaacagcgagcagggcgggcgggcctaccgccacgccatggaggagctgcccgacaccatcgagaccctgatgctcctggcgctgatcgccgtgctcaccggcggggtgaccctgttcttcctgtccggccgggggctcggcaagacgagcatcggcctgctgtgcgtcatcgcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccacgaagaaggacctcgggatcggccacgtggccgtggggaaccaccaccacgcggccatgctggacgtcgacctgcaccccgcctccgcctggaccctctacgccgtggcgaccaccatcatcacgccgatgatgcgccacaccatcgagaacaccaccgccaacatcagcctgacggccatcgccaaccaggccgcgatcctgatgggcctcgacaagggctggcccatctccaagatggacatcggggtgcccctgctggccctcggctgctacagccaggtcaaccccctgaccctgaccgccgccgtgctcatgctggtggcgcactacgccatcatcgggccgggcctgcaggccaaggccacccgcgaggcccagaagcggacggcggccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggccctgtgcgagagcatcaccctggcgaccgggcccctcaccacgctgtgggagggctccccggggaagttctggaacaccaccatcgccgtgagcatggccaacatcttccggggctcctacctggccggcgccgggctcgcgttcagcctgatgaagtccctgggcgggggccgccgggggaccggcgcccagggcgagacgctcggggagaagtggaagcgccagctgaaccagctgtccaagagcgagttcaacacctacaagcggtccggcatcatggaggtggaccgcagcgaggccaaggaggggctcaagcggggcgagaccaccaagcacgccgtctcccgcgggacggcgaagctgcggtggttcgtggagcgcaacctggtgaagcccgagggcaaggtcatcgacctgggctgcgggcggggcgggtggagctactactgcgccggcctcaagaaggtgaccgaggtgaaggggtacaccaagggcggccccgggcacgaggagcccatcccgatggccacctacggctggaacctggtcaagctgcactccgggaaggacgtgttcttcatcccgcccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcacggggaacatcgtgagcgccgtcaacatgacctcccgcatgctcctgaaccgcttcaccatggcccaccggaagcccacctacgagcgcgacgtggacctgggcgcgggcacgcggcacgtggccgtcgagcccgaggtggccaacctcgacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctgctgaccaagccctgggacgtgatccccatggtgacgcagatcgcgatgaccgacaccacccccttcgggcagcagcgggtcttcaaggagaaggtggacacgcgcaccccgaaggccaagcggggcaccgcccagatcatggaggtgaccgccaagtggctctggggcttcctgtcccgcaacaagaagccccggatctgcacgcgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatccccggcggcaacatgtacgcggacgacaccgccgggtgggacacgcggatcaccgaggacgacctccagaacgaggcccgcatcaccgacatcatggagccggagcacgccctgctggccaagtccatcttcaagctcacctaccagaacaaggtggtgcgcgtccagcggcccgcgaagaacggcacggtgatggacgtgatcagccgccgggaccagcgcgggtccggccaggtcggcacctacgggctgaacaccttcaccaacatggaggcccagctgatccggcagatggagagcgagggcatcttctcccccagcgagctcgagacgcccaacctggccgagcgcgtgctggactggctcgagaagtacggggtggagcggctgaagcgcatggccatctccggcgacgactgcgtcgtgaagccgatcgacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgcggtgcccgtcgactggatccccacgtcccggaccacctggagcatccacgcccaccaccagtggatgaccacggaggacatgctgtccgtgtggaaccgcgtgtggatcgaggagaacccctggatggaggacaagacccacatcagctcctggggcgacgtcccgtacctcggcaagcgcgaggaccagtggtgcggcagcctgatcgggctgaccgcccgggccacctgggccaccaacatccaggtggcgatcaaccaggtgcgccggctcatcggcaacgagaactacctggactacatgacgtccatgaagcgcttcaagaacgagagcgaccccgagggggccctgtggtga

SEQ ID NO: 8816 - RNA, 9879 nt, synthetic construct
  misc_feature 1..9879: note = derived and/or modified CDS sequence (opt1) from DENV-1__JQ045632__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcctgacgcaggacgagaagggggtcacccagaacggccggctcatcaccgccaacccgatcgtgaccgacaaggagaagcccgtgaacatcgaggccgagccgcccttcggggagagctacatcgtcatcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccatcgggaagctggtgcaccagatcttcggcaccgcctacggggtcctgttcagcggcgtgtcctggacgatgaagatcgggatcggcgtgctcctgacctggctgggcctcaacagccgctccaccagcctgtccatgacctgcatcgccgtcgggctggtgacgctctacctgggcgtgatggtccaggccgacagcgggtgcgtgatcaactggaagggccgggagctgaagtgcgggtccggcatcttcgtgaccaacgaggtccacacctggaccgagcagtacaagttccaggccgacagcccgaagcgcctcagcgcggccatcggcaaggcctgggaggagggggtgtgcggcatccggtccgccacccgcctggagaacatcatgtggaagcagatcagcaacgagctgaaccacatcctcctggagaacgacatgaagttcacggtggtcgtgggggacgtggccggcatcctggcgcaggggaagaagatgatccggccccagcccatggagcacaagtactcctggaagtcctggggcaaggccaagatcatcggcgccgacgtccagaacaccaccttcatcatcgacgggcccaacaccccggagtgccccgacgaccagcgcgcctggaacatctgggaggtggaggactacggcttcgggatcttcacgaccaacatctggctcaagctgcgggactcctacacccaggtgtgcgaccaccgcctgatgagcgcggccatcaaggactccaaggccgtccacgccgacatgggctactggatcgagagcgagaagaacgagacctggaagctcgcccgggcgtccttcatcgaggtgaagacgtgcatctggcccaagagccacaccctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcacgaccgtcgtggtggacgagcactgcggcaaccgggggccgagcctgcgcaccaccacggtcaccggcaagatcatccacgagtggtgctgccggtcctgcaccctgccgcccctgcgcttccgcggggaggacggctgctggtacgggatggagatccgccccgtgaaggagaaggaggagaacctggtcaagagcatggtctccgccggcagcggcgaggtggacagcttctccctggggctcctgtgcatcagcatcatgatcgaggaggtgatgcggtcccgctggagccggaagatgctgatgaccggcacgctcgccgtcttcttcctgctgatcatggggcagctcacctggaacgacctgatccgcctgtgcatcatggtgggcgccaacgcgtccgaccgcatggggatgggcaccacctacctcgccctgatggccacgttcaagatgcggccgatgttcgccgtggggctcctgttccgccggctgaccagccgcgaggtcctgctcctgaccatcgggctgtccctcgtggccagcgtggagctgcccaactccctggaggagctcggcgacgggctggcgatgggcatcatgatcctgaagctcctgaccgacttccagagccaccagctgtgggccacgctcctgtccctgaccttcatcaagaccaccttcagcctccactacgcctggaagacgatggccatggtcctgtccatcgtgagcctgttccccctctgcctgtccaccaccagccagaagaccacgtggctgcccgtcctcctgggctccctggggtgcaagccgctcaccatgttcctgatcgcggagaacaagatctggggccggcgcagctggcccctgaacgaggggatcatggccgtgggcatcgtgtccatcctcctgagcagcctgctcaagaacgacgtccccctggccgggcccctgatcgccggcggcatgctcatcgcctgctacgtgatctccgggagctccgcggacctgagcctggagaaggccgccgaggtgtcctgggaggaggaggccgagcacagcggcgcctcccacaacatcctcgtcgaggtgcaggacgacgggaccatgaagatcaaggacgaggagcgggacgacaccctgaccatcctgctcaaggcgacgctgctggccgtgagcggcgtctacccgctctccatccccgccaccctgttcgtgtggtacttctggcagaagaagaagcagcgcagcggggtgctgtgggacacccccagcccgcccgaggtcgagcgggccgtgctggacgacggcatctaccgcatcatgcagcggggcctcctggggcgcagccaggtgggcgtcggggtgttccaggagaacgtgttccacaccatgtggcacgtcacgcggggcgccgtgctgatgtaccaggggaagcgcctcgagccctcctgggcgagcgtgaagaaggacctgatctcctacggcggcgggtggcggctgcagggcagctggaacaccggggaggaggtccaggtgatcgccgtggagcccggcaagaaccccaagaacgtccagaccgcccccgggaccttcaagacgcccgagggcgaggtgggcgccatcgccctcgacttcaagcccgggacctccggcagccccatcgtgaaccgcgaggggaagatcgtcggcctgtacggcaacggggtggtgaccacctccggcacgtacgtcagcgcgatcgcccaggccaaggccagccaggaggggccgctgcccgagatcgaggacgaggtgttccggaagcgcaacctcaccatcatggacctgcaccccggctccgggaagacccggcgctacctgccggcgatcgtgcgggaggccatcaagcgcaagctccgcaccctgatcctggcccccacgcgggtcgtggccagcgagatggccgaggcgctcaagggcatgcccatccgctaccagaccaccgccgtgaagtccgagcacaccggcaaggagatcgtcgacctgatgtgccacgccacgttcaccatgcggctgctcagccccgtgcgcgtgccgaactacaacatgatcatcatggacgaggcccacttcaccgacccctccagcatcgccgcgcgggggtacatctccacccgcgtcggcatgggggaggccgccgccatcttcatgacggccacgccgcccggcagcgtggaggcgttcccgcagtccaacgccgtgatccaggacgaggagcgggacatccccgagcgcagctggaactccgggtacgagtggatcaccgacttccccggcaagaccgtctggttcgtgcccagcatcaagtccggcaacgacatcgccaactgcctgaagaagaacgggaagcgggtgatccagctgagccgcaagacgttcgacaccgagtaccagaagaccaagaacaacgactgggactacgtcgtgaccacggacatctccgagatgggcgccaacttccgggcggaccgcgtgatcgacccgcggcgctgcctcaagcccgtcatcctgaaggacgggcccgagcgggtgatcctggccggccccatgccggtgaccgtcgccagcgccgcccagcgccgggggcgcatcggccggaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccgcctgcggggcgaggcgcgcaagacgttcgtggagctgatgcggcgcggggacctccccgtctggctgagctacaaggtggcctccgagggcttccagtacagcgaccggcgctggtgcttcgacggcgagcggaacaaccaggtgctggaggagaacatggacgtcgagatctggaccaaggagggggagcgcaagaagctccggccccgctggctggacgcccggacctacagcgaccccctggccctccgcgagttcaaggagttcgccgcgggccggcgctccgtgagcggggacctgatcctggagatcggcaagctcccgcagcacctgacccagcgggcccagaacgccctggacaacctcgtgatgctgcacaactccgagcagggcgggcgcgcctaccggcacgcgatggaggagctgcccgacacgatcgagaccctcatcctgctggccctcatcgccgtcctgaccggcggggtgaccctgttcttcctcagcggccgcgggctgggcaagacctccatcggcctgctctgcgtgatggccagctccgtcctgctgtggatggccagcgtggagccccactggatcgcggcctccatcatcctcgagttcttcctgatggtgctgctcatccccgagccggaccggcagcgcacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccgccatgctggacgtggacctccaccccgccagcgcctggacgctgtacgcggtcgccaccaccatcatcaccccgatgatgcggcacacgatcgagaacaccaccgccaacatctccctgaccgccatcgccaaccaggcggccatcctcatggggctggacaagggctggcccatcagcaagatggacatcggcgtgcccctgctcgccctggggtgctactcccaggtgaaccccctgacgctcaccgccgcggtcctgatgctggtggcccactacgccatcatcggcccggggctccaggccaaggccacccgcgaggcgcagaagcgcaccgccgccggcatcatgaagaaccccacggtggacgggatcgtcgccatcgacctggaccccgtggtgtacgacgccaagttcgagaagcagctgggccagatcatgctcctgatcctgtgcaccagccagatcctcctgatgcggaccacctgggcgctgtgcgagtccatcacgctcgccaccggccccctgaccaccctgtgggaggggagcccgggcaagttctggaacacgaccatcgccgtctccatggccaacatcttccgcgggagctacctcgccggcgcgggcctggccttctccctgatgaagtccctcgggggcgggcggcgcggcaccggggcccagggcgagaccctgggcgagaagtggaagcggcagctgaaccagctcagcaagtccgagttcaacacgtacaagcgcagcgggatcatggaggtggaccggtccgaggccaaggagggcctgaagcgcggggagaccaccaagcacgcggtgagccggggcaccgccaagctgcgctggttcgtcgagcggaacctggtgaagcccgaggggaaggtgatcgacctcggctgcggccgcgggggctggtcctactactgcgccgggctgaagaaggtcacggaggtgaagggctacaccaagggcgggcccggccacgaggagcccatcccgatggccacctacgggtggaacctggtgaagctccacagcggcaaggacgtcttcttcatcccgcccgagaagtgcgacaccctgctgtgcgacatcggggagtccagccccaacccgacgatcgaggagggccggaccctccgcgtgctgaagatggtggagccctggctgcgggggaaccagttctgcatcaaggtcctcaacccctacatgccctccgtggtggagaccctggagcagatgcagcgcaagcacggcggcatgctggtccggaacccgctcagccgcaactccacccacgagatgtactgggtgagctgcgggaccggcaacatcgtgtccgccgtcaacatgacgagccggatgctgctgaaccgcttcaccatggcgcaccgcaagcccacctacgagcgggacgtggacctcggggccggcacccgccacgtggccgtcgagcccgaggtggccaacctggacatcatcggccagcggatcgagaacatcaagcacgagcacaagtccacgtggcactacgacgaggacaacccctacaagacctgggcctaccacgggagctacgaggtgaagccgtccggcagcgcgtccagcatggtcaacggggtggtcaagctgctcaccaagccctgggacgtgatccccatggtgacccagatcgccatgacggacaccacccccttcggccagcagcgcgtcttcaaggagaaggtggacacccggacgccgaaggccaagcgcgggaccgcccagatcatggaggtgaccgccaagtggctgtggggcttcctgagccggaacaagaagccccgcatctgcacccgggaggagttcacgcgcaaggtccggtccaacgcggccatcggcgccgtgttcgtggacgagaaccagtggaacagcgccaaggaggcggtcgaggacgagcgcttctgggacctcgtgcaccgggagcgcgagctgcacaagcaggggaagtgcgcgacctgcgtgtacaacatgatgggcaagcgggagaagaagctgggggagttcggcaaggccaaggggtcccgcgccatctggtacatgtggctcggcgcccggttcctggagttcgaggcgctgggcttcatgaacgaggaccactggttcagccgcgagaactccctcagcggggtcgagggcgaggggctgcacaagctgggctacatcctccgggacatctccaagatccccgggggcaacatgtacgccgacgacaccgccggctgggacacccgcatcacggaggacgacctgcagaacgaggcccggatcaccgacatcatggagccggagcacgccctgctcgccaagagcatcttcaagctgacctaccagaacaaggtggtgcgcgtccagcgccccgccaagaacgggaccgtgatggacgtgatctcccggcgcgaccagcggggcagcgggcaggtcggcacgtacggcctgaacaccttcaccaacatggaggcccagctcatccgccagatggagtccgaggggatcttcagcccctccgagctggagacccccaacctggccgagcgggtgctcgactggctggagaagtacggcgtggagcgcctgaagcggatggccatcagcggggacgactgcgtcgtgaagccgatcgacgaccgcttcgcgacggccctcaccgccctgaacgacatgggcaaggtgcggaaggacatcccccagtgggagccctccaaggggtggaacgactggcagcaggtccccttctgcagccaccacttccaccagctgatcatgaaggacggccgcgagatcgtggtgccgtgccggaaccaggacgagctcgtcggccgcgcccgggtgtcccagggggccggctggagcctgcgcgagaccgcgtgcctgggcaagagctacgcccagatgtggcagctcatgtacttccaccggcgcgacctgcggctggccgccaacgcgatctgctccgccgtgcccgtcgactggatccccaccagccgcacgacctggtccatccacgcccaccaccagtggatgaccaccgaggacatgctcagcgtgtggaaccgggtgtggatcgaggagaacccctggatggaggacaagacgcacatctccagctggggcgacgtcccgtacctggggaagcgcgaggaccagtggtgcggctccctgatcggcctcaccgcccgcgccacctgggcgaccaacatccaggtggccatcaaccaggtgcggcgcctgatcgggaacgagaactacctggactacatgaccagcatgaagcggttcaagaacgagtccgaccccgagggcgccctctggtga

SEQ ID NO: 8817 - RNA, 9879 nt, synthetic construct
  misc_feature 1..9879: note = derived and/or modified CDS sequence (opt1) from DENV-1__JQ045633__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggagcgtggccctcgcgccccacgtgggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcgccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcgccgcctacggggtgctgttctccggcgtgagctggaccatgaagatcgggatcggcgtcctgctcacctggctgggcctgaactcccgcagcacgtccctcagcatgacctgcatcgccgtggggctggtgaccctgtacctcggcgtcatggtgcaggcggactccgggtgcgtgatcaactggaagggccgggagctgaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtcgtggtgggggacgtcgccggcatcctggcccaggggaagaagatgatccggccccagcccatggagtacaagtacagctggaagtcctggggcaaggccaagatcatcggcgcggacgtgcagaacaccacgttcatcatcgacgggcagaacacccccgagtgcccggacgaccagcgcgcctggaacatctgggaggtggaggactacggcttcgggatcttcaccaccaacatctggctgaagctccgggacagctacacgcaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggccccatcagccagcacaactaccgcccggggtacttcacgcagaccgccggcccctggcacctggggaagctcgagctggacttcgacctgtgcgagggcaccaccgtggtggtcgacgagcactgcggcaaccgggggccctccctccgcacgaccaccgtgaccggcaagatcatccacgagtggtgctgccggagctgcacgctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggcggtgttcctcctgctgatcatggggcagctcacctggaacgacctgatccgcctgtgcatcatggtgggcgccaacgccagcgaccgcatggggatgggcacgacctacctcgccctgatggccaccttcaagatgcggcccatgttcgcggtcggcctcctgttccgccggctgacctcccgcgaggtgctgctcctgacgatcgggctgagcctcgtggcctccgtcgagctgccgaacagcctggaggagctcggcgacgggctggccatgggcatcatgatcctgaagctcctgaccgacttccagtcccaccagctgtgggccaccctcctgagcctgaccttcatcaagacgaccttctccctccactacgcgtggaagaccatggccatggtgctgagcatcgtctccctgttccccctctgcctgagcaccacgtcccagaagaccacctggctgcccgtgctcctgggcagcctggggtgcaagcccctcaccatgttcctgatcgccgagaacaagatctggggccggcgctcctggccgctgaacgaggggatcatggccgtgggcatcgtcagcatcctcctgagctccctgctcaagaacgacgtgcccctggccgggcccctgatcgcgggcggcatgctcatcgcctgctacgtgatcagcgggtccagcgccgacctgtccctggagaaggccgccgaggtcagctgggaggaggaggcggagcactccggcgccagccacaacatcctcgtggaggtgcaggacgacgggacgatgaagatcaaggacgaggagcgggacgacaccctgaccatcctgctcaaggccaccctgctggccgtctccggcgtgtaccccctcagcatcccggccaccctgttcgtgtggtacttctggcagaagaagaagcagcgctccggggtcctgtgggacacgccctccccgcccgaggtggagcgggcggtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagccgagctgggcctccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagaccccggagggcgaggtgggcgcgatcgccctcgacttcaagcccgggaccagcggctcccccatcgtcaaccgcgaggggaagatcgtgggcctgtacggcaacggggtggtcacgaccagcggcacctacgtgagcgccatcgcccaggcgaaggtgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccgcaccctgatcctggccccgacccgggtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccggctgcgcggcgaggcccggaagaccttcgtggagctgatgcgccgcggggacctcccggtgtggctgtcctacaaggtcgccagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctgttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgcgaggcccagaagcggaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggtcctacctcgcgggcgccggcctggccttcagcctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagtacgccgtgtcccgcggcaccgccaagctgcggtggttcgtggagcgcaacctggtcaagccggaggggaaggtgatcgacctcggctgcggccgcggcgggtggagctactactgcgccgggctgaagaaggtgaccgaggtcaaggggtacaccaagggcggccccggccacgaggagcccatccccatggccacgtacgggtggaacctggtgaagctccactccggcaaggacgtgttcttcgtcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccgcttcaccatggcccaccggaagccgacgtacgagcgcgacgtcgacctcggggccggcacccggcacgtggccgtggagcccgaggtcgccaacctggacatcatcggccagcgcatcgagaacatcaagcacgagcacaagagcacctggcactacgacgaggacaacccctacaagacctgggcgtaccacgggtcctacgaggtgaagcccagcggctccgccagcagcatggtcaacggggtggtgaagctgctcacgaagccgtgggacgtcatccccatggtgacccagatcgccatgaccgacaccacgcccttcggccagcagcgggtgttcaaggagaaggtcgacacccgcacccccaaggccaagcgggggaccgcccagatcatggaggtgacggcgaagtggctgtggggcttcctgtcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggcccgcatcaccgacatcatggagcccgagcacgcgctgctcgccaagtccatcttcaagctgacgtaccagaacaaggtcgtgcgcgtgcagcggccggccaagaacgggaccgtcatggacgtgatcagccgccgggaccagcgcggctccggccaggtggggacctacggcctgaacaccttcacgaacatggaggcccagctcatccggcagatggagagcgaggggatcttctcccccagcgagctggagacccccaacctggccgagcgcgtcctcgactggctggagaagtacggcgtggagcggctgaagcgcatggcgatctccggggacgactgcgtggtcaagcccatcgacgaccggttcgccaccgccctcaccgccctgaacgacatgggcaaggtgcgcaaggacatcccgcagtgggagcccagcaaggggtggaacgactggcagcaggtccccttctgctcccaccacttccaccagctgatcatgaaggacggccgggagatcgtcgtgccctgccgcaaccaggacgagctcgtgggccgggcccgcgtcagccagggggcgggctggagcctgcgggagacggcctgcctggggaagtcctacgcccagatgtggcagctcatgtacttccaccgccgggacctgcgcctggccgcgaacgccatctgcagcgccgtgccggtggactggatccccacctcccggaccacctggagcatccacgcccaccaccagtggatgacgaccgaggacatgctctccgtctggaaccgcgtgtggatcgaggagaacccctggatggaggacaagacccacatcagctcctggggcgacgtgccctacctggggaagcgcgaggaccagtggtgcggcagcctgatcggcctcaccgcccgggcgacgtgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8818 - RNA, 9879 nt, synthetic construct
  misc_feature 1..9879: note = derived and/or modified CDS sequence (opt1) from DENV-1__JQ045634__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggagcgtggccctcgcgccccacgtgggcctggggctggagacccgcaccgagacctggatgagctccgagggcgcctggaagcagatccagcgggtggagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcgccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcgccgcctacggggtgctgttctccggcgtgagctggaccatgaagatcgggatcggcgtcctgctcacctggctgggcctgaactcccgcagcacgtccctcagcatgacctgcatcgccgtggggctggtgaccctgtacctcggcgtcatggtgcaggcggactccgggtgcgtgatcaactggaagggccgggagctgaagtgcgggagcggcatcttcgtcaccaacgaggtgcacacgtggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtcgtggtgggggacgtcgccggcatcctggcccaggggaagaagatgatccggccccagcccatggagtacaagtacagctggaagtcctggggcaaggccaagatcatcggcgcggacgtgcagaacaccacgttcatcatcgacgggcagaacacccccgagtgcccggacgaccagcgcgcctggaacatctgggaggtggaggactacggcttcgggatcttcaccaccaacatctggctgaagctccgggacagctacacgcaggtctgcgaccaccgcctgatgtccgccgccatcaaggacagcaaggccgtgcacgcggacatgggctactggatcgagtccgagaagaacgagacctggaagctggcccgggccagcttcatcgaggtgaagacctgcatctggcccaagtcccacaccctctggagcaacggcgtcctggagtccgagatgatcatccccaagatctacgggggccccatcagccagcacaactaccgcccggggtacttcacgcagaccgccggcccctggcacctggggaagctcgagctggacttcgacctgtgcgagggcaccaccgtggtggtcgacgagcactgcggcaaccgggggccctccctccgcacgaccaccgtgaccggcaagatcatccacgagtggtgctgccggagctgcacgctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggcggtgttcctcctgctgatcatggggcagctcacctggaacgacctgatccgcctgtgcatcatggtgggcgccaacgccagcgaccgcatggggatgggcacgacctacctcgccctgatggccaccttcaagatgcggcccatgttcgcggtcggcctcctgttccgccggctgacctcccgcgaggtgctgctcctgacgatcgggctgagcctcgtggcctccgtcgagctgccgaacagcctggaggagctcggcgacgggctggccatgggcatcatgatcctgaagctcctgaccgacttccagtcccaccagctgtgggccaccctcctgagcctgaccttcatcaagacgaccttctccctccactacgcgtggaagaccatggccatggtgctgagcatcgtctccctgttccccctctgcctgagcaccacgtcccagaagaccacctggctgcccgtgctcctgggcagcctggggtgcaagcccctcaccatgttcctgatcgccgagaacaagatctggggccggcgctcctggccgctgaacgaggggatcatggccgtgggcatcgtcagcatcctcctgagctccctgctcaagaacgacgtgcccctggccgggcccctgatcgcgggcggcatgctcatcgcctgctacgtgatcagcgggtccagcgccgacctgtccctggagaaggccgccgaggtcagctgggaggaggaggcggagcactccggcgccagccacaacatcctcgtggaggtgcaggacgacgggacgatgaagatcaaggacgaggagcgggacgacaccctgaccatcctgctcaaggccaccctgctggccgtctccggcgtgtaccccctcagcatcccggccaccctgttcgtgtggtacttctggcagaagaagaagcagcgctccggggtcctgtgggacacgccctccccgcccgaggtggagcgggcggtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagccgagctgggcctccgtcaagaaggacctgatcagctacggcggcgggtggcggctgcagggctcctggaacaccggggaggaggtccaggtgatcgccgtcgagcccggcaagaaccccaagaacgtgcagacggcccccgggaccttcaagaccccggagggcgaggtgggcgcgatcgccctcgacttcaagcccgggaccagcggctcccccatcgtcaaccgcgaggggaagatcgtgggcctgtacggcaacggggtggtcacgaccagcggcacctacgtgagcgccatcgcccaggcgaaggtgtcccaggaggggcccctgccggagatcgaggacgaggtcttccggaagcgcaacctcaccatcatggacctgcaccccggcagcgggaagacgcggcgctacctgcccgccatcgtgcgggaggccatcaagcgcaagctccgcaccctgatcctggccccgacccgggtggtcgcctccgagatggcggaggccctcaagggcatgcccatccgctaccagaccacggccgtcaagagcgagcacaccggcaaggagatcgtggacctgatgtgccacgccaccttcaccatgcggctgctctcccccgtccgcgtgcccaactacaacatgatcatcatggacgaggcccacttcacggacccgagctccatcgcggcccgggggtacatcagcacccgcgtgggcatgggggaggccgccgccatcttcatgaccgcgacgccgcccggctccgtcgaggccttcccccagagcaacgccgtgatccaggacgaggagcgggacatcccggagcgctcctggaacagcgggtacgagtggatcacggacttccccggcaagaccgtgtggttcgtcccctccatcaagagcggcaacgacatcgccaactgcctgcggaagaacgggaagcgcgtgatccagctgtcccggaagaccttcgacaccgagtaccagaagacgaagaacaacgactgggactacgtggtcaccaccgacatcagcgagatgggcgcgaacttccgcgccgaccgggtgatcgacccccgccggtgcctcaagccggtgatcctgaaggacgggcccgagcgcgtcatcctggccggccccatgcccgtgaccgtcgcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgccgcgatcgacggggagtaccggctgcgcggcgaggcccggaagaccttcgtggagctgatgcgccgcggggacctcccggtgtggctgtcctacaaggtcgccagcgagggcttccagtacagcgaccgccggtggtgcttcgacggcgagcgcaacaaccaggtgctggaggagaacatggacgtggagatctggaccaaggagggggagcggaagaagctccgcccccggtggctggacgcccgcacgtactccgaccccctggccctccgggagttcaaggagttcgcggccggccgccggagcgtctccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgacgggcggggtcaccctgttcttcctctccggccgggggctgggcaagaccagcatcggcctgctctgcgtgatggcctccagcgtgctgctgtggatggcgtccgtcgagccccactggatcgccgccagcatcatcctcgagttcttcctgatggtgctgctcatccccgagcccgaccgccagcggaccccgcaggacaaccagctggcctacgtggtcatcgggctcctgttcatgatcctgaccgtggccgcgaacgagatgggcctgctcgagacgaccaagaaggacctggggatcggccacgtggccgtcgagaaccaccaccacgccgccatgctggacgtggacctccaccccgcctccgcgtggaccctgtacgccgtggccaccacgatcatcacccccatgatgcgccacaccatcgagaacaccacggccaacatcagcctgaccgccatcgcgaaccaggccgccatcctcatggggctggacaagggctggccgatctccaagatggacatcggcgtccccctgctcgccctggggtgctacagccaggtgaaccccctgaccctcaccgcggccgtgctgatgctggtcgcccactacgccatcatcggccccgggctccaggccaaggcgacgcgcgaggcccagaagcggaccgccgccggcatcatgaagaacccgaccgtggacgggatcgtggccatcgacctggaccccgtcgtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtgagcatggccaacatcttccgggggtcctacctcgcgggcgccggcctggccttcagcctgatgaagtccctcgggggcgggcgccggggcacgggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagaccacgaagtacgccgtgtcccgcggcaccgccaagctgcggtggttcgtggagcgcaacctggtcaagccggaggggaaggtgatcgacctcggctgcggccgcggcgggtgggcctactactgcgccgggctgaagaaggtgaccgaggtcaaggggtacaccaagggcgggcccggccacgaggagcccatccccatggcgacgtacgggtggaacctggtgaagctccacagcggcaaggacgtgttcttcgtcccgcccgagaagtgcgacaccctgctgtgcgacatcggggagtccagccccaaccccaccatcgaggagggccgcaccctccgggtgctgaagatggtggagccgtggctgcgcgggaaccagttctgcatcaagatcctcaacccctacatgccctccgtcgtggagacgctggagcagatgcagcggaagcacggcggcatgctggtgcgcaaccccctcagccggaactccacccacgagatgtactgggtcagctgcgggaccggcaacatcgtgtccgccgtgaacatgaccagccgcatgctgctgaaccgcttcaccatggcccaccggaagccgacgtacgagcgcgacgtcgacctcggggccggcacccggcacgtggccgtggagcccgaggtcgcgaacctggacatcatcggccagcgcatcgagaacatcaagcacgagcacaagtccacctggcactacgacgaggacaacccctacaagacctgggcctaccacgggagctacgaggtgaagccctccggcagcgcctccagcatggtcaacggggtggtgaagctgctcacgaagccgtgggacgtcatccccatggtgacccagatcgccatgaccgacaccacgcccttcggccagcagcgggtgttcaaggagaaggtcgacacccgcacccccaaggccaagcgggggaccgcgcagatcatggaggtgacggccaagtggctgtggggcttcctgagccgcaacaagaagccgcggatctgcacccgcgaggagttcacccggaaggtgcgctccaacgccgccatcggcgcggtcttcgtggacgagaaccagtggaacagcgccaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtggagggcgaggggctgcacaagctgggctacatcctccgcgacatctccaagatccccgggggcaacatgtacgccgacgacacggccggctgggacacccggatcaccgaggacgacctgcagaacgaggcgcgcatcaccgacatcatggagcccgagcacgccctgctcgccaagagcatcttcaagctgacgtaccagaacaaggtcgtgcgcgtgcagcggccggccaagaacgggaccgtcatggacgtgatctcccgccgggaccagcgcggcagcggccaggtggggacctacggcctgaacaccttcacgaacatggaggcccagctcatccggcagatggagtccgaggggatcttcagcccctccgagctggagacccccaacctggcggagcgcgtcctcgactggctggagaagtacggcgtggagcggctgaagcgcatggccatcagcggggacgactgcgtggtcaagcccatcgacgaccggttcgccaccgccctcaccgccctgaacgacatgggcaaggtgcgcaaggacatcccgcagtgggagccctccaaggggtggaacgactggcagcaggtccccttctgcagccaccacttccaccagctgatcatgaaggacggccgggagatcgtcgtgccctgccgcaaccaggacgagctcgtgggccgggcgcgcgtctcccagggggccggctggagcctgcgggagacggcctgcctgggcaagagctacgcccagatgtggcagctcatgtacttccaccgccgggacctgcgcctggcggccaacgccatctgctccgccgtgccggtggactggatccccaccagccggaccacctggtccatccacgcccaccaccagtggatgacgaccgaggacatgctcagcgtctggaaccgcgtgtggatcgaggagaacccctggatggaggacaagacccacatctccagctggggcgacgtgccctacctggggaagcgcgaggaccagtggtgcggctccctgatcggcctcaccgcgcgggccacgtgggccaccaacatccaggtcgccatcaaccaggtgcgccggctgatcgggaacgagaactacctggactacatgaccagcatgaagcgcttcaagaacgagtccgacccggagggcgccctctggtga

SEQ ID NO: 8819 - RNA, 9879 nt, synthetic construct
  misc_feature 1..9879: note = derived and/or modified CDS sequence (opt1) from DENV-1__JQ045636__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccatcgcgaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggccacccagaacggccggctgatcaccgccaacccgatcgtgacggacaaggagaagcccgtgaacatcgaggcggagccgcccttcggggagagctacatcgtcatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtgttcacctccgtggggaagctggtccaccagatcttcggcacggcctacggggtgctgttcagcggcgtgtcctggaccatgaagatcgggatcggcgtcctcctgacctggctgggcctcaacagccgctccaccagcctgtccatgacgtgcatcgccgtggggctggtgaccctctacctgggcgtcatggtgcaggcggacagcgggtgcgtgatcaactggaagggccgggagctgaagtgcgggagcggcatcttcgtcaccaacgaggtgcacacctggacggagcagtacaagttccaggccgactccccgaagcgcctcagcgccgccatcggcaaggcctgggaggagggggtgtgcggcatccggtccgcgacccgcctggagaacatcatgtggaagcagatcagcaacgagctgaaccacatcctcctggagaacgacatgaagctgaccgtcgtggtgggggacgtcgccggcatcctcgcccaggggaagaagatgatccggccccagcccatggagtacaagtactcctggaagtcctggggcaaggccaagatcatcggcgcggacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggactcctacacccaggtctgcgaccaccgcctcatgagcgccgccatcaaggactccaaggccgtgcacgcggacatgggctactggatcgagagcgagaagaacgagacgtggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgacgggcaccctggcggtgttcttcctgctcatcatggggcagctgacctggaacgacctgatccggctctgcatcatggtgggcgccgacgcctccgaccgcatggggatgggcaccacgtacctggccctgatggccaccttcaagatgcgcccgatgttcgcggtcgggctcctgttccggcgcctgaccagccgggaggtgctcctgctgaccatcgggctctccctggtggccagcgtcgagctgcccaactccctcgaggagctgggcgacgggctggccatgggcatcatgatcctcaagctgctgacggacttccagagccaccagctctgggccaccctgctgtccctcaccttcatccgcaccacgttcagcctgcactacgcgtggaagaccatggccatggtgctgtccatcgtcagcctcttccccctgtgcctgtccaccaccagccagaagacgacctggctccccgtgctgctgggctccctcgggtgcaagccgctgaccatgttcctgatcgccgagaacaagatctggggccgcaagagctggcccctcaacgaggggatcatggccgtgggcatcgtcagcatcctgctgtccagcctcctgaagaacgacgtgcccctggccgggcccctcatcgcgggcggcatgctgatcgcctgctacgtgatctccgggagctccgccgacctgagcctcgagaaggccgccgtcgtgtcctgggaggaggaggcggagcacagcggcgcctcccacaacatcctggtggaggtccaggacgacgggaccatgaagatcaaggacgaggagcgcgacgacacgctgaccatcctcctgaaggccaccctgctcgccgtgagcggcgtgtacccgctgtccatccccgccaccctgttcgtctggtacttctggcagaagaagaagcagcggagcggggtgctctgggacacccccagcccgcccgaggtggagcgcgcggtcctggacgacggcatctaccggatcatgcagcgcggcctgctggggcggagccaggtgggcgtgggggtcttccaggagaacgtgttccacacgatgtggcacgtgacccgcggcgccgtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagaccgcccccgggacgttcaagacctccgagggcgaggtcggcgcgatcgccctggacttcaagcccgggaccagcggcagccccatcgtgaaccgggaggggaagatcgtgggcctgtacggcaacggggtcgtgaccacgtccggcacctacgtgagcgccatcgcccaggcgaaggcctcccaggaggggcccctcccggagatcgaggacgaggtcttccgcaagcggaacctgaccatcatggacctgcaccccggcagcgggaagacccgccggtacctccccgccatcgtgcgcgaggccatcaagcggaagctgcgcacgctgatcctcgccccgacccgcgtggtcgcgtccgagatggccgaggccctgaagggcatgcccatccggtaccagaccaccgccgtcaagagcgagcacacgggcaaggagatcgtggacctgatgtgccacgccaccttcaccatgcgcctcctgtcccccgtccgggtgcccaactacaacatgatcatcatggacgaggcgcacttcaccgacccgagctccatcgccgcccgcgggtacatcagcacgcgggtgggcatgggggaggccgccgcgatcttcatgaccgccacgccgcccggctccgtcgaggccttcccccagagcaacgccgtgatccaggacgaggagcgcgacatcccggagcggtcctggaacagcgggtacgagtggatcaccgacttccccggcaagacggtgtggttcgtcccctccatcaagagcggcaacgacatcgcgaactgcctgcgcaagaacgggaagcgggtgatccagctctcccgcaagaccttcgacaccgagtaccagaagaccaagaacaacgactgggactacgtggtcacgaccgacatcagcgagatgggcgccaacttccgggccgaccgcgtgatcgacccccggcgctgcctgaagccggtgatcctgaaggacgggcccgagcgggtcatcctcgccggccccatgcccgtgaccgtcgcctccgcggcccagcgccgggggcgcatcggccggaaccacaacaaggagggcgaccagtacatctacatggggcagccgctgaacaacgacgaggaccacgcccactggaccgaggccaagatgctgctcgacaacatcaacacgcccgagggcatcatccccgccctgttcgaccccgagcgcgagaagtccgcggccatcgacggggagtaccgcctgcggggcgaggcccgcaagaccttcgtggagctcatgcggcgcggggacctgccggtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgcgctgcgcgagttcaaggagttcgccgccggccggcgcagcgtctccggggacctgatcctcgagatcggcaagctgccccagcacctgacgcagcgggcccagaacgcgctcgacaacctggtgatgctgcacaacagcgagcagggcgggcgcgcctaccggcacgccatggaggagctcccggacaccatcgagaccctgatgctgctcgccctgatcgccgtgctgaccggcggggtcaccctgttcttcctgtccggccgcgggctgggcaagaccagcatcggcctcctgtgcgtgatggcgtccagcgtgctgctctggatggcctccgtcgagccccactggatcgccgccagcatcatcctggagttcttcctgatggtgctcctgatccccgagcccgaccggcagcgcaccccgcaggacaaccagctggcctacgtggtcatcgggctcctgttcatgatcctgaccgtggcggccaacgagatgggcctcctggagaccacgaagaaggacctggggatcggccacgtggccgtcgagaaccaccaccacgccgccatgctcgacgtggacctgcaccccgcgtccgcctggaccctgtacgccgtggccaccaccatcatcacgcccatgatgcggcacaccatcgagaacaccaccgccaacatcagcctcacggcgatcgccaaccaggccgccatcctgatggggctggacaagggctggccgatctccaagatggacatcggcgtccccctcctggcgctggggtgctacagccaggtgaaccccctcaccctgaccgccgccgtgctgatgctcgtcgcccactacgccatcatcggccccgggctgcaggcgaaggccacccgcgaggcccagaagcgcacggccgccggcatcatgaagaacccgaccgtggacgggatcgtggcgatcgacctggaccccgtcgtgtacgacgccaagttcgagaagcagctcggccagatcatgctgctgatcctctgcacctcccagatcctgctgatgcggaccacgtgggccctctgcgagagcatcaccctggccaccggccccctgaccacgctctgggaggggtcccccggcaagttctggaacaccaccatcgccgtgagcatggcgaacatcttccgcgggagctacctggccggcgccggcctggccttctccctcatgaagtccctcgggggcgggcggcgcgggaccggggcgcagggcgagacgctgggcgagaagtggaagcggcagctcaaccagctgtccaagagcgagttcaacacctacaagcgctccgggatcatggaggtcgaccggagcgaggccaaggagggcctgaagcgcggggagaccaccaagcacgccgtgtcccggggcacggccaagctccgctggttcgtggagcggaacctggtcaagccggaggggaaggtgatcgacctgggctgcggccgcgggggctggagctactactgcgccgggctgaagaaggtgaccgaggtcaagggctacaccaagggcgggcccggccacgaggagcccatccccatggcgacctacgggtggaacctcgtgaagctgcactccggcaaggacgtgttcttcatcccgcccgagaagtgcgacacgctgctctgcgacatcggggagagctcccccaaccccaccatcgaggagggccggaccctgcgcgtcctgaagatggtggagccgtggctccgggggaaccagttctgcatcaagatcctgaacccctacatgcccagcgtggtcgagaccctggagcagatgcagcgcaagcacggcggcatgctcgtgcggaaccccctgtcccgcaacagcacgcacgagatgtactgggtgtcctgcgggaccggcaacatcgtcagcgccgtgaacatgacctcccggatgctgctcaaccgcttcaccatggcccaccgcaagccgacctacgagcgggacgtggacctgggggccggcacgcgccacgtcgccgtggagcccgaggtggcgaacctggacatcatcggccagcggatcgagaacatcaagcacgagcacaagagcacctggcactacgacgaggacaacccctacaagacctgggcctaccacgggtcctacgaggtcaagcccagcggcagcgcctccagcatggtgaacggggtcgtgaagctcctgaccaagccgtgggacgtgatccccatggtcacgcagatcgccatgaccgacaccacccccttcggccagcagcgcgtgttcaaggagaaggtggacacgcggacccccaaggccaagcgcgggaccgcgcagatcatggaggtcaccgccaagtggctgtggggcttcctctcccggaacaagaagccgcgcatctgcacgcgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacaccgccggctgggacacgcgcatcaccgaggacgacctgcagaacgaggcgaagatcaccgacatcatggagcccgagcacgccctcctggccaagtccatcttcaagctgacctaccagaacaaggtggtccgggtgcagcgcccggccaagaacgggacggtgatggacgtcatcagccgccgggaccagcgcggctccggccaggtgggcacctacggcctcaacaccttcaccaacatggaggcccagctgatccggcagatggagagcgaggggatcttctcccccagcgagctggagacgcccaacctcgcgggccgcgtgctggactggctggagaagcacggggtcgagcggctcaagcgcatggccatctccggcgacgactgcgtggtgaagcccatcgacgaccggttcgccaccgccctgaccgccctgaacgacatggggaaggtccgcaaggacatcccgcagtgggagcccagcaagggctggaacgactggcagcaggtccccttctgcagccaccacttccaccagctcatcatgaaggacggccgggagatcgtggtcccctgccgcaaccaggacgagctggtggggcgggcgcgcgtgtcccagggcgccgggtggagcctgcgggagaccgcctgcctcggcaagtcctacgcccagatgtggcagctgatgtacttccaccgccgggacctgcgcctcgcggccaacgccatctgcagcgccgtcccggtggactgggtgcccacgtcccggaccacctggagcatccacgcccaccaccagtggatgaccacggaggacatgctgtccgtctggaaccgcgtgtggatcgaggagaacccctggatggaggacaagacccacatcagctcctggggcgacgtgccctacctgggcaagcgggaggaccagtggtgcggcagcctcatcgggctgaccgcgcgcgccacctgggccacgaacatccaggtcgccatcaaccaggtgcgccggctgctcggcaacgagaactacctggactacatgacctccatgaagcgcttcaagaacgagagcgacccggagggggccctgtggtga

SEQ ID NO: 8820 - RNA, 9879 nt, synthetic construct
  misc_feature 1..9879: note = derived and/or modified CDS sequence (opt1) from DENV-1__JQ045635__SS-prME
  source 1..9879: mol_type = other RNA
agcgtgaccatgctgctcatgctgatgcccaccgccctggccttccacctcacgacccgcggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctcgggctggagacgcgcaccgagacctggatgagctccgagggcgcctggaagcagatccagcgggtcgagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccatcgcgaccatcacgccccaggcccccagcaccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggcctccaccagccaggagacctggaaccggcaggacctcctggtgaccttcaagacggcccacgcgaagaagcaggaggtcgtggtgctgggctcccaggagggcgccatgcacaccgccctcaccggggccaccgagatccagacgagcggcaccaccaccatcttcgccgggcacctgaagtgccgcctgaagatggacaagctcacgctgaagggcatgtcctacgtcatgtgcaccgggagcttcaagctggagaaggaggtggcggagacccagcacggcaccgtgctcgtccagatcaagtacgagggcacggacgccccctgcaagatccccttctccacccaggacgagaagggggccacccagaacggccggctgatcaccgccaacccgatcgtgacggacaaggagaagcccgtgaacatcgaggcggagccgcccttcggggagagctacatcgtcatcggcgccggcgagaaggccctgaagctgtcctggttcaagaaggggagctccatcggcaagatgttcgaggccaccgcccgcggggcgcggcgcatggccatcctcggcgacaccgcctgggacttcgggagcatcggcggcgtgttcacctccgtggggaagctggtccaccagatcttcggcacggcctacggggtgctgttcagcggcgtgtcctggaccatgaagatcgggatcggcgtcctcctgacctggctgggcctcaacagccgctccaccagcctgtccatgacgtgcatcgccgtggggctggtgaccctctacctgggcgtcatggtgcaggcggacagcgggtgcgtgatcaactggaagggccgggagctgaagtgcgggagcggcatcttcgtcaccaacgaggtgcacacctggacggagcagtacaagttccaggccgactccccgaagcgcctcagcgccgccatcggcaaggcctgggaggagggggtgtgcggcatccggtccgcgacccgcctggagaacatcatgtggaagcagatcagcaacgagctgaaccacatcctcctggagaacgacatgaagctgaccgtcgtggtgggggacgtcgccggcatcctcgcccaggggaagaagatgatccggccccagcccatggagtacaagtactcctggaagtcctggggcaaggccaagatcatcggcgcggacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggactcctacacccaggtctgcgaccaccgcctcatgagcgccgccatcaaggactccaaggccgtgcacgcggacatgggctactggatcgagagcgagaagaacgagacgtggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtggtggtcgacgagcactgcggcaaccgggggccgagcctgcgcaccacgaccgtgaccggcaagatcatccacgagtggtgctgccggtcctgcaccctgccgcccctccgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgacgggcaccctggcggtgttcttcctgctcatcatggggcagctgacctggaacgacctgatccggctctgcatcatggtgggcgccgacgcctccgaccgcatggggatgggcaccacgtacctggccctgatggccaccttcaagatgcgcccgatgttcgcggtcgggctcctgttccggcgcctgaccagccgggaggtgctcctgctgaccatcgggctctccctggtggccagcgtcgagctgcccaactccctcgaggagctgggcgacgggctggccatgggcatcatgatcctcaagctgctgacggacttccagagccaccagctctgggccaccctgctgtccctcaccttcatccgcaccacgttcagcctgcactacgcgtggaagaccatggccatggtgctgtccatcgtcagcctcttccccctgtgcctgtccaccaccagccagaagacgacctggctccccgtgctgctgggctccctcgggtgcaagccgctgaccatgttcctgatcgccgagaacaagatctggggccgcaagagctggcccctcaacgaggggatcatggccgtgggcatcgtcagcatcctgctgtccagcctcctgaagaacgacgtgcccctggccgggcccctcatcgcgggcggcatgctgatcgcctgctacgtgatctccgggagctccgccgacctgagcctcgagaaggccgccgtcgtgtcctgggaggaggaggcggagcacagcggcgcctcccacaacatcctggtggaggtccaggacgacgggaccatgaagatcaaggacgaggagcgcgacgacacgctgaccatcctcctgaaggccaccctgctcgccgtgagcggcgtgtacccgctgtccatccccgccaccctgttcgtctggtacttctggcagaagaagaagcagcggagcggggtgctctgggacacccccagcccgcccgaggtggagcgcgcggtcctggacgacggcatctaccggatcatgcagcgcggcctgctggggcggagccaggtgggcgtgggggtcttccaggagaacgtgttccacacgatgtggcacgtgacccgcggcgccgtcctcatgtaccaggggaagcggctggagccctcctgggccagcgtgaagaaggacctgatctcctacggcggcgggtggcgcctccagggcagctggaacaccggggaggaggtgcaggtcatcgccgtggagcccggcaagaaccccaagaacgtgcagaccgcccccgggacgttcaagacctccgagggcgaggtcggcgcgatcgccctggacttcaagcccgggaccagcggcagccccatcgtgaaccgggaggggaagatcgtgggcctgtacggcaacggggtcgtgaccacgtccggcacctacgtgagcgccatcgcccaggcgaaggcctcccaggaggggcccctcccggagatcgaggacgaggtcttccgcaagcggaacctgaccatcatggacctgcaccccggcagcgggaagacccgccggtacctccccgccatcgtgcgcgaggccatcaagcggaagctgcgcacgctgatcctcgccccgacccgcgtggtcgcgtccgagatggccgaggccctgaagggcatgcccatccggtaccagaccaccgccgtcaagagcgagcacacgggcaaggagatcgtggacctgatgtgccacgccaccttcaccatgcgcctcctgtcccccgtccgggtgcccaactacaacatgatcatcatggacgaggcgcacttcaccgacccgagctccatcgccgcccgcgggtacatcagcacgcgggtgggcatgggggaggccgccgcgatcttcatgaccgccacgccgcccggctccgtcgaggccttcccccagagcaacgccgtgatccaggacgaggagcgcgacatcccggagcggtcctggaacagcgggtacgagtggatcaccgacttccccggcaagacggtgtggttcgtcccctccatcaagagcggcaacgacatcgcgaactgcctgcgcaagaacgggaagcgggtgatccagctctcccgcaagaccttcgacaccgagtaccagaagaccaagaacaacgactgggactacgtggtcacgaccgacatcagcgagatgggcgccaacttccgggccgaccgcgtgatcgacccccggcgctgcctgaagccggtgatcctgaaggacgggcccgagcgggtcatcctcgccggccccatgcccgtgaccgtcgcctccgcggcccagcgccgggggcgcatcggccggaaccacaacaaggagggcgaccagtacatctacatggggcagccgctgaacaacgacgaggaccacgcccactggaccgaggccaagatgctgctcgacaacatcaacacgcccgagggcatcatccccgccctgttcgaccccgagcgcgagaagtccgcggccatcgacggggagtaccgcctgcggggcgaggcccgcaagaccttcgtggagctcatgcggcgcggggacctgccggtgtggctgagctacaaggtcgcctccgagggcttccagtacagcgaccggcgctggtgcttcgacggcgagcggaacaaccaggtgctcgaggagaacatggacgtggagatctggaccaaggagggggagcgcaagaagctgcggccccgctggctggacgcccggacctactccgaccccctcgcgctgcgcgagttcaaggagttcgccgccggccggcgcagcgtctccggggacctgatcctcgagatcggcaagctgccccagcacctgacgcagcgggcccagaacgcgctcgacaacctggtgatgctgcacaacagcgagcagggcgggcgcgcctaccggcacgccatggaggagctcccggacaccatcgagaccctgatgctgctcgccctgatcgccgtgctgaccggcggggtcaccctgttcttcctgtccggccgcgggctgggcaagaccagcatcggcctcctgtgcgtgatggcgtccagcgtgctgctctggatggcctccgtcgagccccactggatcgccgccagcatcatcctggagttcttcctgatggtgctcctgatccccgagcccgaccggcagcgcaccccgcaggacaaccagctggcctacgtggtcatcgggctcctgttcatgatcctgaccgtggcggccaacgagatgggcctcctggagaccacgaagaaggacctggggatcggccacgtggccgtcgagaaccaccaccacgccgccatgctcgacgtggacctgcaccccgcgtccgcctggaccctgtacgccgtggccaccaccatcatcacgcccatgatgcggcacaccatcgagaacaccaccgccaacatcagcctcacggcgatcgccaaccaggccgccatcctgatggggctggacaagggctggccgatctccaagatggacatcggcgtccccctcctggcgctggggtgctacagccaggtgaaccccctcaccctgaccgccgccgtgctgatgctcgtcgcccactacgccatcatcggccccgggctgcaggcgaaggccacccgcgaggcccagaagcgcacggccgccggcatcatgaagaacccgaccgtggacgggatcgtggcgatcgacctggaccccgtcgtgtacgacgccaagttcgagaagcagctcggccagatcatgctgctgatcctctgcacctcccagatcctgctgatgcggaccacgtgggccctctgcgagagcatcaccctggccaccggccccctgaccacgctctgggaggggtcccccggcaagttctggaacaccaccatcgccgtgagcatggcgaacatcttccgcgggagctacctggccggcgccggcctggccttctccctcatgaagtccctcgggggcgggcggcgcgggaccggggcgcagggcgagacgctgggcgagaagtggaagcggcagctcaaccagctgtccaagagcgagttcaacacctacaagcgctccgggatcatggaggtcgaccggagcgaggccaaggagggcctgaagcgcggggagaccaccaagcacgccgtgtcccggggcacggccaagctccgctggttcgtggagcggaacctggtcaagccggaggggaaggtgatcgacctgggctgcggccgcgggggctgggcctactactgcgcggggctgaagaaggtgaccgaggtcaagggctacaccaagggcgggcccggccacgaggagcccatccccatggccacctacgggtggaacctcgtgaagctgcacagcggcaaggacgtgttcttcatcccgcccgagaagtgcgacacgctgctctgcgacatcggggagtccagccccaaccccaccatcgaggagggccggaccctgcgcgtcctgaagatggtggagccgtggctccgggggaaccagttctgcatcaagatcctgaacccctacatgccctccgtggtcgagaccctggagcagatgcagcgcaagcacggcggcatgctcgtgcggaaccccctgagccgcaactccacgcacgagatgtactgggtgagctgcgggaccggcaacatcgtctccgccgtgaacatgaccagccggatgctgctcaaccgcttcaccatggcccaccgcaagccgacctacgagcgggacgtggacctgggggccggcacgcgccacgtcgcggtggagcccgaggtggccaacctggacatcatcggccagcggatcgagaacatcaagcacgagcacaagtccacctggcactacgacgaggacaacccctacaagacctgggcctaccacgggagctacgaggtcaagccctccggcagcgccagctccatggtgaacggggtcgtgaagctcctgaccaagccgtgggacgtgatccccatggtcacgcagatcgccatgaccgacaccacccccttcggccagcagcgcgtgttcaaggagaaggtggacacgcggacccccaaggcgaagcgcgggaccgcccagatcatggaggtcaccgccaagtggctgtggggcttcctcagccggaacaagaagccgcgcatctgcacgcgggaggagttcacccgcaaggtgcggtccaacgccgcgatcggcgccgtgttcgtcgacgagaaccagtggaacagcgccaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggcgaaggggtcccgcgccatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacaccgcgggctgggacacgcgcatcaccgaggacgacctgcagaacgaggccaagatcaccgacatcatggagcccgagcacgccctcctggccaagagcatcttcaagctgacctaccagaacaaggtggtccgggtgcagcgcccggccaagaacgggacggtgatggacgtcatctcccgccgggaccagcgcggcagcggccaggtgggcacctacggcctcaacaccttcaccaacatggaggcgcagctgatccggcagatggagtccgaggggatcttcagcccctccgagctggagacgcccaacctcgccggccgcgtgctggactggctggagaagcacggggtcgagcggctcaagcgcatggccatcagcggcgacgactgcgtggtgaagcccatcgacgaccggttcgccaccgccctgaccgcgctgaacgacatggggaaggtccgcaaggacatcccgcagtgggagccctccaagggctggaacgactggcagcaggtccccttctgcagccaccacttccaccagctcatcatgaaggacggccgggagatcgtggtcccctgccgcaaccaggacgagctggtggggcgggcccgcgtgagccagggcgccgggtggtccctgcgggagaccgcctgcctcggcaagagctacgcgcagatgtggcagctgatgtacttccaccgccgggacctgcgcctcgccgccaacgccatctgctccgccgtcccggtggactgggtgcccacgagccggaccacctggtccatccacgcgcaccaccagtggatgaccacggaggacatgctgagcgtctggaaccgcgtgtggatcgaggagaacccctggatggaggacaagacccacatctccagctggggcgacgtgccctacctgggcaagcgggaggaccagtggtgcggctccctcatcgggctgaccgcccgcgccacctgggccacgaacatccaggtcgccatcaaccaggtgcgccggctgctcggcaacgagaactacctggactacatgaccagcatgaagcgcttcaagaacgagtccgacccggagggggcgctgtggtga

SEQ ID NO: 8821 - RNA, 9879 nt, synthetic construct
  misc_feature 1..9879: note = derived and/or modified CDS sequence (opt1) from DENV-1__JQ045637__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagatgtccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggccggcatcctcgcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggctcccgggggccgagcctgcgcaccaccaccgtgacgggcaagatcatccacgagtggtgctgccggtcctgcaccctgccgcccctccgcttccgcggggaggacggctgctggtacgggatggagatccgccccgtcaaggagaaggaggagaacctggtgaagtccatggtgagcgccggctccggcgaggtcgacagcctctccctggggctgctctgcatcagcatcatgatcgaggaggtgatgcggtcccgctggagccggaagatgctgatgaccggcaccctggccgtgttcttcctcctgatcatggggcagctgacgtggaacgacctcatccgcctgtgcatcatggtcggcgccaacgcgtccgaccgcatggggatgggcaccacctacctggccctcatggccgccttcaagatgcggccgatgttcgccgtgggcctgctgttccgccggctcaccagccgcgaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatcaagacgaccttcagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccggcgcagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgcgaggggaagatcgtgggcctctacggcaacggggtcgtgacgaccagcggcacctacgtgtccgccatcgcccaggccaaggcgagccaggaggggccgctgcccgagatcgaggacgaggtcttccggaagcgcaacctgaccatcatggacctccaccccggctccgggaagacgcggcgctacctgccggccatcgtgcgggaggccatcaagcgcaagctgcgcaccctcatcctggcccccacccgggtggtcgccagcgagatggcggaggccctgaagggcatgcccatccgctaccagaccacggccgtgaagtccgagcacaccggcaaggagatcgtggacctcatgtgccacgccaccttcaccatgcggctgctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctccggaagaacgggaagcgcgtgatccagctgagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctcaaggacgggcccgagcgcgtcatcctggccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtgtggctcagctacaaggtcgccagcgagggcttccagtactccgaccgccggtggtgcttcgacggcgagcgcaacaaccaggtgctggaggagaacatggacgtggagatctggaccaaggagggggagcggaagaagctgcgcccccggtggctcgacgcccgcacgtacagcgaccccctggccctgcgggagttcaaggagttcgcggccggccgccggtccgtcagcggggacctcatcctggagatcggcaagctgccgcagcacctcacccagcgcgcccagaacgccctggacaacctggtgatgctccacaactccgagcagggcgggcgggcgtaccgccacgccatcgaggagctgcccgacaccatcgagaccctgatgctcctggccctgatcgccgtgctcacgggcggggtcaccctgttcttcctgagcggccgggggctcggcaagacctccatcggcctgctgtgcgtgatggccagctccgtgctcctgtggatggcgagcgtcgagccccactggatcgccgcctccatcatcctggagttcttcctcatggtgctgctgatccccgagccggaccgccagcggacgccccaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgccagcgcgtggaccctctacgccgtggccaccacgatcatcaccccgatgatgcgccacaccatcgagaacaccacggccaacatctccctgaccgccatcgcgaaccaggccgccatcctgatggggctcgacaagggctggcccatcagcaagatggacatcggcgtccccctgctggccctcgggtgctactcccaggtgaaccccctgaccctgaccgcggccgtgctcatgctggtcgcccactacgccatcatcggcccggggctgcaggccaaggcgacgcgcgaggcccagaagcggaccgccgccggcatcatgaagaaccccaccgtggacgggatcgtggccatcgacctcgaccccgtcgtgtacgacgcgaagttcgagaagcagctgggccagatcatgctgctcatcctgtgcaccagccagatcctgctcatgcgcacgacctgggccctgtgcgagtccatcaccctggccaccggccccctcacgaccctgtgggaggggagcccgggcaagttctggaacaccaccatcgccgtgtccatggccaacatcttccgggggagctacctggcgggcgccggcctcgccttcagcctgatgaagtccctcgggggcgggcgccgggggacgggggcccagggcgagaccctcggcgagaagtggaagcgccagctgaaccagctgagcaagtccgagttcaacacctacaagcggagcgggatcatggaggtcgaccgctccgaggcgaaggagggcctcaagcgcggggagaccacgaagcacgccgtgagccgcggcaccgccaagctgcggtggttcgtggagcgcaacctggtcaagcccgaggggaaggtgatcgacctgggctgcggccgcggcgggtggtcctactactgcgccgggctcaagaaggtgaccgaggtcaaggggtacaccaagggcggccccggccacgaggagcccatcccgatggccacgtacgggtggaacctggtgaagctgcacagcggcaaggacgtgttcttcatcccgcccgagaagtgcgacaccctcctgtgcgacatcggggagtccagccccaacccgaccatcgaggagggccgcaccctgcgggtcctcaagatggtggagccctggctgcgcgggaaccagttctgcatcaagatcctgaacccctacatgccctccgtggtcgagacgctcgagcagatgcagcggaagcacggcggcatgctggtgcgcaacccgctgagccggaactccacccacgagatgtactgggtgagctgcgggaccggcaacatcgtctccgcggtgaacatgaccagccgcatgctcctgaaccgcttcaccatggcccaccggaagcccacgtacgagcgcgacgtggacctgggggccggcacccggcacgtcgccgtggagcccgaggtggccaacctcgacatcatcggccagcgcatcgagaacatcaagcacgagcacaagtccacctggcactacgacgaggacaacccctacaagacctgggcgtaccacgggagctacgaggtcaagccgtccggcagcgccagctccatggtgaacggggtcgtgaagctgctgacgaagccctgggacgtgatccccatggtcacccagatcgccatgaccgacaccacgcccttcggccagcagcgggtgttcaaggagaaggtggacacccgcaccccgaaggccaagcgggggaccgcccagatcatggaggtcacggcgaagtggctctggggcttcctgagccgcaacaagaagccccggatctgcacccgcgaggagttcacccggaaggtgcgctccaacgccgccatcggcgccgtgttcgtcgacgagaaccagtggaacagcgcgaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgccgacgacacggccggctgggacacccggatcaccgaggacgacctccagaacgaggcccgcatcaccgacatcatggagccggagcacgcgctgctggcccgcagcatcttcaagctcacgtaccagaacaaggtggtccgggtgcagcgccccgccaagaacgggaccgtgatggacgtcatctcccggcgcgaccagcggggcagcggccaggtggggacctacggcctgaacaccttcacgaacatggaggcccagctgatccgccagatggagtccgaggggatcttcagcccctccgagctcgagacccccaacctggccgagcgggtgctggactggctcgagaagtacggcgtcgagcgcctgaagcggatggcgatcagcggggacgactgcgtggtgaagccgatcgacgaccgcttcgccaccgccctgaccgccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgagccagggggcgggctggtccctccgcgagacggcctgcctgggcaagagctacgcccagatgtggcagctgatgtacttccaccggcgcgacctccggctggccgcgaacgccatctgctccgccgtccccgtggactggatccccaccagccgcaccacctggtccatccacgcccaccaccagtggatgacgaccgaggacatgctgagcgtgtggaaccgcgtctggatcgaggagaacccctggatggaggacaagacccacatctccagctggggcgacgtgccgtacctcgggaagcgggaggaccagtggtgcggctccctgatcggcctgaccgcccgcgcgacgtgggccaccaacatccaggtggccatcaaccaggtccggcgcctcatcgggaacgagaactacctggactacatgaccagcatgaagcggttcaagaacgagtccgaccccgagggcgccctgtggtga

SEQ ID NO: 8822 - RNA, 9879 nt, synthetic construct
  misc_feature 1..9879: note = derived and/or modified CDS sequence (opt1) from DENV-1__JQ045638__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagatgtccggcaccacgaccatcttcgccgggcacctgaagtgccgcctcaagatggacaagctgaccctgaagggcatgagctacgtcatgtgcaccgggtccttcaagctcgagaaggaggtggccgagacgcagcacggcaccgtgctggtccagatcaagtacgagggcaccgacgcgccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccaccgcccgcggggcccggcgcatggccatcctgggcgacacggcgtgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggccggcatcctcgcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggctcccgggggccgagcctgcgcaccaccaccgtgacgggcaagatcatccacgagtggtgctgccggtcctgcaccctgccgcccctccgcttccgcggggaggacggctgctggtacgggatggagatccgccccgtcaaggagaaggaggagaacctggtgaagtccatggtgagcgccggctccggcgaggtcgacagcctctccctggggctgctctgcatcagcatcatgatcgaggaggtgatgcggtcccgctggagccggaagatgctgatgaccggcaccctggccgtgttcttcctcctgatcatggggcagctgacgtggaacgacctcatccgcctgtgcatcatggtcggcgccaacgcgtccgaccgcatggggatgggcaccacctacctggccctcatggccgccttcaagatgcggccgatgttcgccgtgggcctgctgttccgccggctcaccagccgcgaggtgctgctgctcacgatcgggctgtccctggtcgcgagcgtggagctccccaactccctggaggagctgggcgacgggctcgccatgggcatcatgatcctgaagctgctcaccgacttccagagccaccagctgtgggccaccctgctctccctgaccttcatcaagacgaccttcagcctgcactacgcctggaagaccatggcgatggtcctctccatcgtgagcctgttccccctgtgcctctccaccacgagccagaagaccacctggctgcccgtgctgctcggctccctggggtgcaagccgctgaccatgttcctcatcgccgagaacaagatctggggccggcgcagctggcccctgaacgaggggatcatggccgtcggcatcgtgagcatcctgctctccagcctgctgaagaacgacgtgcccctcgccgggcccctgatcgccggcggcatgctgatcgcgtgctacgtcatctccgggagctccgccgacctcagcctggagaaggccgccgaggtgtcctgggaggaggaggccgagcacagcggcgcgtcccacaacatcctggtggaggtccaggacgacgggacgatgaagatcaaggacgaggagcgggacgacaccctcaccatcctgctgaaggccaccctcctggccgtgagcggcgtgtacccgctgtccatccccgccaccctcttcgtctggtacttctggcagaagaagaagcagcgcagcggggtgctgtgggacacgcccagcccgcccgaggtggagcgggccgtcctggacgacggcatctaccgcatcatgcagcggggcctgctcgggcgcagccaggtgggcgtgggggtcttccaggagaacgtgttccacaccatgtggcacgtgacccggggcgcggtcctgatgtaccaggggaagcgcctggagccctcctgggccagcgtgaagaaggacctcatctcctacggcggcgggtggcggctgcagggcagctggaacaccggggaggaggtgcaggtcatcgccgtggagcccggcaagaaccccaagaacgtgcagacggcccccgggaccttcaagacccccgagggcgaggtcggcgccatcgcgctggacttcaagcccgggacctccggcagccccatcgtgaaccgcgaggggaagatcgtgggcctctacggcaacggggtcgtgacgaccagcggcacctacgtgtccgccatcgcccaggccaaggcgagccaggaggggccgctgcccgagatcgaggacgaggtcttccggaagcgcaacctgaccatcatggacctccaccccggctccgggaagacgcggcgctacctgccggccatcgtgcgggaggccatcaagcgcaagctgcgcaccctcatcctggcccccacccgggtggtcgccagcgagatggcggaggccctgaagggcatgcccatccgctaccagaccacggccgtgaagtccgagcacaccggcaaggagatcgtggacctcatgtgccacgccaccttcaccatgcggctgctgagccccgtccgcgtgccgaactacaacatgatcatcatggacgaggcccacttcacggacccctccagcatcgcggcccgggggtacatctccacccgcgtgggcatgggggaggccgccgccatcttcatgaccgcgacgccgcccggcagcgtcgaggccttcccgcagtccaacgccgtgatccaggacgaggagcgggacatccccgagcgcagctggaactccgggtacgagtggatcacggacttccccggcaagaccgtgtggttcgtccccagcatcaagtccggcaacgacatcgccaactgcctccggaagaacgggaagcgcgtgatccagctgagccggaagaccttcgacaccgagtaccagaagacgaagaacaacgactgggactacgtggtcaccaccgacatctccgagatgggcgcgaacttccgcgccgaccgggtgatcgacccgcgccggtgcctgaagcccgtgatcctcaaggacgggcccgagcgcgtcatcctggccggccccatgccggtgaccgtcgccagcgccgcgcagcggcgcgggcggatcggccgcaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccggctccgcggcgaggcccggaagaccttcgtggagctgatgcgccgcggggacctgcccgtgtggctcagctacaaggtcgccagcgagggcttccagtactccgaccgccggtggtgcttcgacggcgagcgcaacaaccaggtgctggaggagaacatggacgtggagatctggaccaaggagggggagcggaagaagctgcgcccccggtggctcgacgcccgcacgtacagcgaccccctggccctgcgggagttcaaggagttcgcggccggccgccggtccgtcagcggggacctcatcctggagatcggcaagctgccgcagcacctcacccagcgcgcccagaacgccctggacaacctggtgatgctccacaactccgagcagggcgggcgggcgtaccgccacgccatcgaggagctgcccgacaccatcgagaccctgatgctcctggccctgatcgccgtgctcacgggcggggtcaccctgttcttcctgagcggccgggggctcggcaagacctccatcggcctgctgtgcgtgatggccagctccgtgctcctgtggatggcgagcgtcgagccccactggatcgccgcctccatcatcctggagttcttcctcatggtgctgctgatccccgagccggaccgccagcggacgccccaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgccagcgcgtggaccctctacgccgtggccaccacgatcatcaccccgatgatgcgccacaccatcgagaacaccacggccaacatctccctgaccgccatcgcgaaccaggccgccatcctgatggggctcgacaagggctggcccatcagcaagatggacatcggcgtccccctgctggccctcgggtgctactcccaggtgaaccccctgaccctgaccgcggccgtgctcatgctggtcgcccactacgccatcatcggcccggggctgcaggccaaggcgacgcgcgaggcccagaagcggaccgccgccggcatcatgaagaaccccaccgtggacgggatcgtggccatcgacctcgaccccgtcgtgtacgacgcgaagttcgagaagcagctgggccagatcatgctgctcatcctgtgcaccagccagatcctgctcatgcgcacgacctgggccctgtgcgagtccatcaccctggccaccggccccctcacgaccctgtgggaggggagcccgggcaagttctggaacaccaccatcgccgtgtccatggccaacatcttccgggggagctacctggcgggcgccggcctcgccttcagcctgatgaagtccctcgggggcgggcgccgggggacgggggcccagggcgagaccctcggcgagaagtggaagcgccagctgaaccagctgagcaagtccgagttcaacacctacaagcggagcgggatcatggaggtcgaccgctccgaggcgaaggagggcctcaagcgcggggagaccacgaagcacgccgtgagccgcggcaccgccaagctgcggtggttcgtggagcgcaacctggtcaagcccgaggggaaggtgatcgacctgggctgcggccgcgggggctgggcctactactgcgccgggctcaagaaggtgaccgaggtcaagggctacaccaagggcggccccggccacgaggagcccatcccgatggcgacgtacgggtggaacctggtgaagctgcactccggcaaggacgtgttcttcatcccgcccgagaagtgcgacaccctcctgtgcgacatcggggagagctcccccaacccgaccatcgaggagggccgcaccctgcgggtcctcaagatggtggagccctggctgcgcgggaaccagttctgcatcaagatcctgaacccctacatgcccagcgtggtcgagacgctcgagcagatgcagcggaagcacggcggcatgctggtgcgcaacccgctgtcccggaacagcacccacgagatgtactgggtgtcctgcgggaccggcaacatcgtcagcgccgtgaacatgacctcccgcatgctcctgaaccgcttcaccatggcccaccggaagcccacgtacgagcgcgacgtggacctgggggccggcacccggcacgtcgccgtggagcccgaggtggcgaacctcgacatcatcggccagcgcatcgagaacatcaagcacgagcacaagagcacctggcactacgacgaggacaacccctacaagacctgggcctaccacgggtcctacgaggtcaagccgagcggctccgccagcagcatggtgaacggggtcgtgaagctgctgacgaagccctgggacgtgatccccatggtcacccagatcgccatgaccgacaccacgcccttcggccagcagcgggtgttcaaggagaaggtggacacccgcaccccgaaggccaagcgggggaccgcgcagatcatggaggtcacggccaagtggctctggggcttcctgtcccgcaacaagaagccccggatctgcacccgcgaggagttcacccggaaggtgcgcagcaacgccgccatcggcgcggtgttcgtcgacgagaaccagtggaactccgccaaggaggccgtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggcgatctggtacatgtggctgggcgcccgcttcctcgagttcgaggccctgggcttcatgaacgaggaccactggttctcccgggagaacagcctgtccggggtggagggcgaggggctccacaagctgggctacatcctgcgcgacatcagcaagatccccgggggcaacatgtacgccgacgacacggccggctgggacacccggatcaccgaggacgacctccagaacgaggcgcgcatcaccgacatcatggagccggagcacgccctgctggcccgctccatcttcaagctcacgtaccagaacaaggtggtccgggtgcagcgccccgccaagaacgggaccgtgatggacgtcatcagccggcgcgaccagcggggctccggccaggtggggacctacggcctgaacaccttcacgaacatggaggcccagctgatccgccagatggagagcgaggggatcttctcccccagcgagctcgagacccccaacctggcggagcgggtgctggactggctcgagaagtacggcgtcgagcgcctgaagcggatggccatctccggggacgactgcgtggtgaagccgatcgacgaccgcttcgccaccgccctgaccgccctcaacgacatgggcaaggtccggaaggacatcccccagtgggagcccagcaaggggtggaacgactggcagcaggtccccttctgctcccaccacttccaccagctgatcatgaaggacggccgcgagatcgtggtcccgtgccggaaccaggacgagctggtgggccgcgcgcgggtgagccagggggccggctggagcctccgcgagacggcctgcctggggaagtcctacgcccagatgtggcagctgatgtacttccaccggcgcgacctccggctggcggccaacgccatctgcagcgccgtccccgtggactggatccccacctcccgcaccacctggagcatccacgcccaccaccagtggatgacgaccgaggacatgctgtccgtgtggaaccgcgtctggatcgaggagaacccctggatggaggacaagacccacatcagctcctggggcgacgtgccgtacctcgggaagcgggaggaccagtggtgcggcagcctgatcggcctgaccgcgcgcgccacgtgggccaccaacatccaggtggccatcaaccaggtccggcgcctcatcgggaacgagaactacctggactacatgacctccatgaagcggttcaagaacgagagcgaccccgagggcgccctgtggtga

SEQ ID NO: 8823 - RNA, 9879 nt, synthetic construct
  misc_feature 1..9879: note = derived and/or modified CDS sequence (opt1) from DENV-1__JQ045639__SS-prME
  source 1..9879: mol_type = other RNA
agcgtgaccatgttcctgatgctcatgcccaccgccctggccttccacctgaccacccggggcggggagccccacatgatcgtgagcaagcaggagcggggcaagagcctcctgttcaagaccagcgccggggtgaacatgtgcaccctgatcgccatggacctcggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctggcgccccacgtgggcctcgggctggagacccgcaccgagacctggatgagctccgagggcgcctggaagcagatccagcgggtcgagacgtgggccctgcgccaccccgggttcaccgtgatcgccctcttcctggcccacgcgatcggcaccagcatcacccagaaggggatcatcttcatcctgctcatgctggtgacgccctccatggccatgcggtgcgtcggcatcggcagccgcgacttcgtggaggggctgtccggcgccacctgggtggacgtcgtgctcgagcacgggagctgcgtgaccaccatggccaaggacaagcccacgctggacatcgagctgctcaagaccgaggtcaccaaccccgccgtgctgcggaagctgtgcatcgaggcgaagatctccaacaccacgaccgacagccgctgcccgacccagggcgaggccaccctcgtggaggagcaggacgccaacttcgtctgccggcgcacgttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctcacgctggactgcagcccccgcaccggcctggacttcaacgagatggtcctcctgaccatgaaggagaagtcctggctggtgcacaagcagtggttcctcgacctgcccctgccctggaccagcggggccagcacgtcccaggagacctggaaccggcaggacctcctggtgaccttcaagaccgcccacgccaagaagcaggaggtcgtggtgctgggcagccaggagggcgcgatgcacacggccctcaccggggccaccgagatccagacctccggcacgaccaccatcttcgccgggcacctgaagtgccgcctgaagatggacaagctcaccctgaagggcatgagctacgtcatgtgcacggggtccttcaagctggagaaggagctcgccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcgccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcacgctggccgtgttcttcctgctcatcatggggcagctgacctggaacgacctgatccgcctctgcatcatggtgggcgccaacgcgagcgaccgcatggggatgggcaccacctacctggccctgatggccacgttcaagatgcggccgatgttcgccgtcggcctcctgttccgccggctgacctcccgcgaggtgctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtgggcatcgtcagcatcctgctgagctccctcctgaagaacgacgtgcccctggccgggcccctcatcgccggcggcatgctgatcgcctgctacgtgatcagcgggtccagcgcggacctgtccctcgagaaggccgccgaggtcagctgggaggaggaggccgagcactccggcgccagccacaacatcctggtggaggtgcaggacgacgggaccatgaagatcaaggacgaggagcgggacgacaccctgaccatcctcctgaaggcgacgctgctcgccgtctccggcgtgtacccgctgagcatccccgccaccctgttcgtgtggcacttctggcagaagaagaagcagcgctccggggtcctctgggacacccccagcccgcccgaggtggagcgggccgtgctggacgacggcatctaccgcatcatgcagcggggcctgctggggcgctcccaggtcggcgtgggggtgttccaggagaacgtcttccacaccatgtggcacgtgacgcggggcgccgtgctcatgtaccaggggaagcgcctggagcccagctgggcgtccgtcaagaaggacctgatcagctacggcggcgggtggcggctccagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctgtacggcaacggggtggtcaccaccagcggcacgtacgtgagcgcgatcgcccaggcccgggcctcccaggaggggccgctccccgagatcgaggacgaggtgttccgcaagcggaacctgaccatcatggacctgcaccccggcagcgggaagacccgccggtacctcccggcgatcgtccgcgaggccatcaagcgcaagctgcggaccctgatcctcgcccccacgcgcgtggtggcctccgagatggccgaggcgctgaagggcatgcccatccggtaccagaccaccgccgtcaagagcgagcacaccggcaaggagatcgtggacctgatgtgccacgccacgttcaccatgcgcctcctgtcccccgtgcgggtcccgaactacaacatgatcatcatggacgaggcccacttcaccgaccccagctccatcgccgcgcgcgggtacatcagcacccgggtgggcatgggggaggccgccgccatcttcatgacggccacgccgcccggctccgtggaggcgttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtgatcctcgccggccccatgccggtcaccgtggcctccgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagacgttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacctactccgaccccctcgccctgcgcgagttcaaggagttcgccgcgggccggcgcagcgtgtccggggacctgatcctcgagatcggcaagctgccgcagcacctgacccagcgggcccagaacgccctcgacaacctggtcatgctgcacaacagcgagcagggcgggcgcgcctaccggcacgcgatggaggagctccccgacacgatcgagaccctgatgctgctcgccctgatcgccgtgctgaccggcggggtgaccctcttcttcctgtccggccgcgggctgggcaagaccagcatcggcctcctgtgcgtcatggcctccagcgccctgctctggatggcgtccgtggagccccactggatcgccgccagcatcatcctggagttcttcctgatggtgctcctgatccccgagccggaccggcagcgcacgccccaggacaaccagctggcctacgtcgtgatcgggctcctgttcatgatcctgaccgtggccgcgaacgagatgggcctcctggagaccaccaagaaggacctggggatcggccacgccgccgtcgagaaccaccaccacgccgccatgctcgacgtggacctgcaccccgcgtccgcctggacgctgtacgccgtggccaccaccatcatcaccccgatgatgcgccacacgatcgagaacaccaccgccaacatcagcctcaccgcgatcgccaaccaggccgccatcctgatggggctggacaagggctggcccatctccaagatggacatcggcgtccccctcctggcgctggggtgctacagccaggtgaaccccctcacgctgaccgccgccgtgctgatgctcgtcgcccactacgccatcatcggcccggggctgcaggcgaaggccacccgggaggcccagaagcgcaccgccgccggcatcatgaagaaccccacggtggacgggatcgtggcgatcgacctggaccccgtcgtgtacgacgccaagttcgagaagcagctcggccagatcatgctgctgatcctctgcacctcccagatcctgctgatgcggaccacctgggccctctgcgagagcatcacgctggccaccggccccctgaccaccctctgggaggggtccccgggcaagttctggaacacgaccatcgccgtgagcatggcgaacatcttccgcgggtcctacctggccggcgccggcctggccttcagcctcatgaagtccctcgggggcgggcggcgcgggaccggggcgcagggcgagaccctgggcgagaagtggaagcggcagctcaaccagctgtccaagagcgagttcaacacgtacaagcgctccgggatcatggaggtcgaccggagcgaggccaaggagggcctgaagcgcggggagaccaccaagcacgccgtgtcccggggcaccgccaagctccgctggttcgtggagcggaacctggtcaagcccgaggggaaggtgatcgacctgggctgcggccgcgggggctggagctactactgcgccgggctgaagaaggtgacggaggtcaagggctacaccaagggcggccccggccacgaggagcccatcccgatggcgacctacgggtggaacctcgtgaagctgcactccggcaaggacgtgttcttcatcccgcccgagaagtgcgacaccctgctctgcgacatcggggagagctcccccaacccgacgatcgaggagggccggaccctgcgcgtcctgaagatggtggagccctggctccgggggaaccagttctgcatcaagatcctgaacccctacatgcccagcgtggtcgagaccctggagcagatgcagcgcaagcacggcggcatgctcgtgcggaacccgctgtcccgcaacagcacccacgagatgtactgggtgtcctgcgggaccggcaacatcgtcagcgccgtgaacatgacgtcccgcatgctgctcaaccggttcaccatggcccaccgcaagcccacctacgagcgggacgtggacctgggggccggcacccgccacgtcgccgtggagcccgaggtggcgaacctggacatcatcggccagcggatcgagaacatcaagcacgagcacaagagcacgtggcactacgacgaggacaacccctacaagacctgggcctaccacgggtcctacgaggtcaagccgagcggctccgccagcagcatggtgaacggggtggtcaagctcctgaccaagccctgggacgtgatccccatggtcacccagatcgccatgacggacaccacccccttcggccagcagcgcgtgttcaaggagaaggtggacacccggacgccgaaggccaagcgcgggaccgcgcagatcatggaggtcaccgccaagtggctgtggggcttcctctcccggaacaagaagccccgcatctgcacccgggaggagttcacgcgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggcggtgcgcgacctgcgtctacaacatgatgggcaagcgcgagaagaagctcggggagttcggcaaggccaaggggagccgggcgatctggtacatgtggctgggcgcccgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccgcatcacggaggacgacctgcagaacgaggcgcggatcaccgacatcatggagccggagcacgccctcctggccaagtccatcttcaagctgacctaccagaacaaggtggtccgcgtgcagcggcccgccaagaacgggaccgtgatggacgtcatcagccgccgggaccagcgcggctccggccaggtggggacgtacggcctcaacaccttcaccaacatggaggcccagctgatccggcagatggagagcgaggggatcttctcccccagcgagctggagacccccaacctcgcggagcgcgtgctggactggctggagaagtacggcgtcgagcggctcaagcgcatggccatctccggggacgactgcgtggtgaagccgatcgacgaccggttcgccacggccctgaccgccctgaacgacatgggcaaggtccgcaaggacatcccccagtgggagcccagcaaggggtggaacgactggcagcaggtccccttctgctcccaccacttccaccagctcatcatgaaggacggccgggagatcgtggtcccgtgccgcaaccaggacgagctggtgggccgggcgcgcgtgagccagggggccggctggagcctgcgggagaccgcctgcctcgggaagtcctacgcccagatgtggcagctgatgtacttccaccgccgggacctgcgcctcgcggccaacgccatctgcagcgccgtccccgtggactggatccccacctcccgcacgacctggagcatccacgcccaccaccagtggatgaccaccgaggacatgctgtccgtgtggaaccgggtctggatcgaggagaacccctggatggaggacaagacgcacatcagctcctgggaggacgtgccgtacctgggcaagcgcgaggaccagtggtgcgggagcctcatcggcctgaccgcgcgggccacctgggccaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8824 - RNA, 9879 nt, synthetic construct
  misc_feature 1..9879: note = derived and/or modified CDS sequence (opt1) from DENV-1__JQ045641__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcgcccagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcttcctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcggcctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccctgtccctccactacgcctggaagaccatggcgatggtgctgagcatcgtctccctgttccccctctgcctgagcacgacctcccagaagaccacctggctgcccgtgctcctgggcagcctggggtgcaagccgctcacgatgttcctgatcgccgagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcgtgctacgtgatcagcgggtccagcgccgacctgtccctggagaaggccgccgaggtcagctgggaggaggaggccgagcactccggcgcgagccacaacatcctcgtggaggtgcaggacgacgggaccatgaagatcaaggacgaggagcgggacgacaccctgaccatcctgctcaaggccaccctgctggccgtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgcggtgctgatgtaccaggggaagcgcctcgagcccagctgggcctccgtcaagaaggacctgatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctcgacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtccgggaggccatcaagcgcaagctccgcaccctgatcctggcccccacccgggtggtggcctccgagatggcggaggccctcaagggcatgcccatccgctaccagacgaccgccgtcaagagcgagcacaccggcaaggagatcgtggacctgatgtgccacaccacgttcaccatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctcaagcccgtgatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctgttcatgatcctgaccgtcgccgccaacgagatgggcctgctcgagaccaccaagaaggacctggggatcggccacgtggcggtggagaaccaccaccacgccgccatgctggacgtcgacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtcaaccccctgacgctcaccgccgcggtgctgatgctggtggcccactacgccatcatcggcccggggctccaggccaaggccacccgcgaggcgcagaagcggaccgccgccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtctcccgcggcaccgccaagctgcggtggttcgtggagcgcaacctggtgaagcccgaggggaaggtcatcgacctcggctgcggccgcggcgggtggagctactactgcgccgggctgaagaaggtgacggaggtgaaggggtacaccaagggcggccccggccacgaggagcccatcccgatggccacctacgggtggaacctggtcaagctccactccggcaaggacgtgttcttcatcccgcccgagaagtgcgacaccctgctgtgcgacatcggggagagctcccccaacccgacgatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggaccggcaacatcgtgagcgccgtcaacatgacgtcccgcatgctgctgaaccgcttcaccatggcgcaccggaagcccacctacgagcgcgacgtggacctcggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctcatccggcagatggagagcgaggggatcttctcccccagcgagctggagacccccaacctggccgagcgcgtgctcgactggctggagaagtacggcgtggagcggctgaagcgcatggccatctccggggacgactgcgtcgtgaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcgtgcctggggaagtcctacgcccagatgtggcagctcatgtacttccaccgccgggacctgcgcctggccgccaacgcgatctgcagcgccgtgcccgtcgactggatccccacctcccggacgacctggagcatccacgcccaccaccagtggatgaccaccgaggacatgctctccgtgtggaaccgcgtgtggatcgaggagaacccctggatggaggacaagacgcacatcagctcctggggcgacgtcccgtacctggggaagcgcgaggaccagtggtgcggcagcctgatcggcctcaccgcccgggccacctgggcgaccaacatccaggtggccatcaaccaggtgcgccggctgatcgggaacgagaactacctggactacatgacctccatgaagcgcttcaagaacgagagcgaccccgagggcgccctctggtga

SEQ ID NO: 8825 - RNA, 9879 nt, synthetic construct
  misc_feature 1..9879: note = derived and/or modified CDS sequence (opt1) from DENV-1__JQ045642__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcctggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtgcgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtcctcttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccacgttcaagatgcggccgatgttcgccgtggggctcctgttccgccggctgacctcccgcgaggtgctcctgctgaccatcgggctcagcctggtcgcctccgtggagctgcccaacagcctcgaggagctgggcgacgggctggcgatgggcatcatgatcctcaagctgctgaccgacttccagtcccaccagctctgggccacgctgctgagcctcaccttcatcaagaccaccttctccctgcactacgcctggaagacgatggccatggtcctgagcatcgtgtccctcttccccctgtgcctgagcaccacctcccagaagaccacgtggctccccgtgctgctgggcagcctcgggtgcaagccgctgaccatgttcctgatcgcggagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcctgctacgtcatcagcgggtccagcgcggacctgtccctcgagaaggccgccgaggtgagctgggaggaggaggccgagcactccggcgccagccacaacatcctggtggaggtccaggacgacgggaccatgaagatcaaggacgaggagcgggacgacaccctgaccatcctcctgaaggcgacgctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacaccatgtggcacgtgacgcgcggggccgtcctcatgtaccagggcaagcgcctggagcccagctgggcgtccgtgaagaaggacctgatcagctacggcgggggctggcggctccaggggtcctggaacaccggcgaggaggtgcaggtcatcgccgtggagcccgggaagaaccccaagaacgtgcagaccgcccccggcaccttcaagacgcccgagggcgaggtcggggccatcgccctggacttcaagcccggcaccagcgggtcccccatcgtgaaccgcgagggcaagatcgtgggcctgtacgggaacggcgtcgtgaccaccagcgggacgtacgtgagcgcgatcgcccaggccaaggcctcccaggagggcccgctccccgagatcgaggacgaggtcttccggaagcgcaacctgaccatcatggacctgcaccccgggagcggcaagacccggcgctacctcccggcgatcgtgcgggaggccatcaagcgcaagctgcgcaccctgatcctcgcccccacgcgggtggtcgcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtccgcgtgccgaactacaacatgatcatcatggacgaggcccacttcaccgaccccagctccatcgccgcgcggggctacatcagcacccgcgtggggatgggcgaggccgccgccatcttcatgacggccacgccgcccgggtccgtcgaggcgttcccgcagagcaacgccgtgatccaggacgaggagcgggacatccccgagcgctcctggaacagcggctacgagtggatcaccgacttccccggcaagaccgtgtggttcgtcccctccatcaagagcgggaacgacatcgccaactgcctgcggaagaacggcaagcgcgtgatccagctctcccggaagacgttcgacaccgagtaccagaagaccaagaacaacgactgggactacgtggtcaccacggacatcagcgagatgggggccaacttccgcgcggaccgggtgatcgacccgcgccggtgcctgaagcccgtgatcctgaaggacggccccgagcgcgtcatcctcgccgggcccatgccggtgaccgtcgcctccgccgcccagcggcgcggccggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggggaggcgcggaagacgttcgtggagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgccgcggggcgccggagcgtctccggcgacctgatcctcgagatcggcaagctgccgcagcacctgacccagcgcgcccagaacgccctcgacaacctggtgatgctgcacaacagcgagcagggcgggcgggcctaccgccacgcgatggaggagctccccgacacgatcgagaccctgatgctgctcgccctgatcgccgtgctgaccgggggcgtcaccctcttcttcctgtccgggcggggcctgggcaagaccagcatcgggctcctgtgcgtgatggcctccagcgtgctgctctggatggcctccgtcgagccccactggatcgcggccagcatcatcctggagttcttcctgatggtgctcctgatccccgagccggaccgccagcggacgccccaggacaaccagctggcctacgtggtcatcggcctcctgttcatgatcctgaccgtggccgccaacgagatggggctcctggagaccaccaagaaggacctgggcatcgggcacgtggcggtcgagaaccaccaccacgccgccatgctcgacgtggacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatgggcctggacaagggctggcccatctccaagatggacatcggggtccccctcctggccctgggctgctacagccaggtgaaccccctcacgctgaccgccgcggtgctgatgctcgtcgcccactacgccatcatcgggccgggcctgcaggccaaggccacccgcgaggcgcagaagcggaccgccgccgggatcatgaagaaccccacggtggacggcatcgtggccatcgacctggaccccgtcgtgtacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccggggaagttctggaacacgaccatcgccgtgagcatggccaacatcttccggggctcctacctggccggcgcggggctggccttcagcctcatgaagtccctgggcgggggccgccgggggaccggcgcccagggcgagaccctgggggagaagtggaagcgccagctcaaccagctgtccaagagcgagttcaacacgtacaagcggtccggcatcatggaggtcgaccgcagcgaggccaaggaggggctgaagcggggcgagaccaccaagcacgcggtgtcccgcgggaccgccaagctccggtggttcgtggagcgcaacctggtcaagcccgagggcaaggtgatcgacctgggctgcgggcggggcgggtggagctactactgcgccggcctgaagaaggtgacggaggtcaaggggtacaccaagggcggccccgggcacgaggagcccatcccgatggccacctacggctggaacctcgtgaagctgcactccgggaaggacgtgttcttcatcccgcccgagaagtgcgacaccctgctctgcgacatcggcgagagctcccccaacccgacgatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcaccgggaacatcgtcagcgccgtgaacatgacgtcccgcatgctgctcaaccgcttcaccatggcgcaccggaagcccacctacgagcgcgacgtggacctgggcgccggcacccggcacgtcgccgtggagcccgaggtggccaacctggacatcatcgggcagcgcatcgagaacatcaagcacgagcacaagagcacgtggcactacgacgaggacaacccctacaagacctgggcctaccacggctcctacgaggtcaagccgagcgggtccgcgagcagcatggtgaacggcgtcgtgaagctcctgaccaagccctgggacgtgatccccatggtcacccagatcgccatgacggacaccacccccttcgggcagcagcgggtgttcaaggagaaggtggacacccgcacgccgaaggccaagcggggcaccgcccagatcatggaggtcaccgccaagtggctgtggggcttcctctcccgcaacaagaagccccggatctgcacccgcgaggagttcacgcggaaggtgcgcagcaacgcggccatcggggccgtgttcgtcgacgagaaccagtggaactccgccaaggaggcggtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatccccggcggcaacatgtacgccgacgacaccgccgggtgggacacccggatcacggaggacgacctgcagaacgaggcccgcatcaccgacatcatggagccggagcacgccctcctggcgaagtccatcttcaagctgacctaccagaacaaggtggtccgcgtgcagcggcccgccaagaacggcaccgtgatggacgtcatcagccgccgggaccagcgcgggtccggccaggtgggcacgtacgggctcaacaccttcaccaacatggaggcccagctgatccggcagatggagagcgagggcatcttctcccccagcgagctggagacccccaacctcgccgagcgcgtgctggactggctggagaagtacggggtcgagcggctcaagcgcatggccatctccggcgacgactgcgtggtgaagccgatcgacgaccggttcgcgacggccctgaccgccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcgtgcctcggcaagtcctacgcccagatgtggcagctgatgtacttccaccgccgggacctgcgcctcgccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctgggcaagcgcgaggaccagtggtgcggcagcctcatcgggctgaccgcccgggccacctgggcgaccaacatccaggtggccatcaaccaggtccgccggctgatcggcaacgagaactacctcgactacatgacctccatgaagcgcttcaagaacgagagcgaccccgagggggccctgtggtga

SEQ ID NO: 8826 - RNA, 9879 nt, synthetic construct
  misc_feature 1..9879: note = derived and/or modified CDS sequence (opt1) from DENV-1__JQ045644__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcgtggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcacgctggccgtgttcttcctgctcatcatggggcagctgacctggaacgacctgatccgcctctgcatcatggtcggcgccaacgcgagcgaccgcatggggatgggcaccacctacctggccctgatggccgccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgggacgacaccctgaccatcctcctgaaggccaccctgctcgccgtgtccggcgtgtacccgctgagcatccccgccacgctgttcgtctggtacttctggcagaagaagaagcagcgctccggggtgctctgggacacccccagcccgcccgaggtggagcgggccgtcctggacgacggcatctaccgcatcatgcagcggggcctgctggggcgctcccaggtgggcgtgggggtcttccaggagaacgtgttccacaccatgtggcacgtgacccggggcgcggtcctcatgtaccaggggaagcgcctggagcccagctgggcctccgtgaagaaggacctgatcagctacggcggcgggtggcggctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgcgaggggaagatcgtgggcctgtacggcaacggggtcgtgaccaccagcggcacctacgtgagcgccatcgcccaggccaaggcgtcccaggaggggccgctccccgagatcgaggacgaggtcttccggaagcgcaacctgacgatcatggacctgcaccccggcagcgggaagacccggcgctacctcccggccatcgtgcgggaggccatcaagcgcaagctgcgcaccctgatcctcgcccccacccgggtggtcgcctccgagatggcggaggccctgaagggcatgcccatccgctaccagacgaccgccgtcaagagcgagcacaccggcaaggagatcgtggacctgatgtgccacgccaccttcacgatgcggctcctgtcccccgtccgcgtgccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgccaactgcctgcggaagaacgggaagcgcgtgatccagctctcccggaagaccttcgacacggagtaccagaagaccaagaacaacgactgggactacgtggtcaccaccgacatcagcgagatgggcgcgaacttccgcgccgaccgggtgatcgacccgcgccggtgcctgaagcccgtgatcctgaaggacgggcccgagcgcgtcatcctcgccggccccatgccggtgacggtcgcctccgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccggctgcgcggcgaggcccggaagaccttcgtggagctcatgcgccgcggggacctgcccgtgtggctgtcctacaaggtcgccagcgagggcttccagtacagcgaccgccggtggtgcttcgacggcgagcgcaacaaccaggtgctcgaggagaacatggacgtggagatctggacgaaggagggggagcggaagaagctgcgcccccggtggctggacgcccgcacctactccgaccccctcgccctgcgggagttcaaggagttcgcggccggccgccggagcgtctccggggacctgatcctcgagatcggcaagctgccgcagcacctgacccagcgcgcccagaacgccctcgacaacctggtgatgctgcacaacagcgagcagggcgggcgggcgtaccgccacgccatggaggagctccccgacaccatcgagacgctgatgctgctcgccctgatcgccgtgctgaccggcggggtcaccctcttcttcctgtccggccgggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgcgaggcccagaagcggaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggccacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcgggaaccagttctgcatcaagatcctgaacccctacatgcccagcgtggtcgagaccctggagcagatgcagcggaagcacggcggcatgctcgtgcgcaacccgctgtcccggaacagcacccacgagatgtactgggtgtcctgcgggaccggcaacatcgtcagcgcggtgaacatgacctcccgcatgctgctcaaccgcttcacgatggcccaccggaagcccacctacgagcgcgacgtggacctgggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgaagtggctgtggggcttcctctcccgcaacaagaagccccggatctgcacccgcgaggagttcacccggaaggtgcgcagcaacgccgccatcggcgccgtgttcgtcgacgagaaccagtggaactccgcgaaggaggccgtggaggacgagcggttctgggacctggtgcaccgcgagcgggagctgcacaagcaggggaagtgcgccacgtgcgtctacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggcccgcatcacggacatcatggagccggagcacgcgctcctggcccgctccatcttcaagctgacctaccagaacaaggtggtccgggtgcagcgccccgccaagaacgggaccgtgatggacgtcatcagccggcgcgaccagcggggctccggccaggtggggacctacggcctcaacacgttcaccaacatggaggcccagctgatccgccagatggagagcgaggggatcttctcccccagcgagctggagacccccaacctcgccgagcgggtgctggactggctggagaagtacggcgtcgagcgcctcaagcggatggcgatctccggggacgactgcgtggtgaagccgatcgacgaccgcttcgccaccgccctgacggccctgaacgacatgggcaaggtccggaaggacatcccccagtgggagcccagcaaggggtggaacgactggcagcaggtccccttctgctcccaccacttccaccagctcatcatgaaggacggccgcgagatcgtggtcccgtgccggaaccaggacgagctggtgggccgcgcccgggtgagccagggggcgggctggagcctgcgcgagaccgcctgcctcgggaagtcctacgcccagatgtggcagctgatgtacttccaccggcgcgacctgcggctcgccgcgaacgccatctgcagcgccgtccccgtggactggatccccacctcccgcaccacgtggagcatccacgcccaccaccagtggatgaccaccgaggacatgctgtccgtgtggaaccgcgtctggatcgaggagaacccctggatggaggacaagacccacatcagctcctggggcgacgtgccgtacctggggaagcgggaggaccagtggtgcggcagcctcatcggcctgacggcccgcgcgacctgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 8827 - RNA, 9879 nt, synthetic construct
  misc_feature 1..9879: note = derived and/or modified CDS sequence (opt1) from DENV-1__JQ045648__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcgcccagaacggccggctgatcaccgccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcttcctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcggcctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccctgtccctccactacgcctggaagaccatggcgatggtgctgagcatcgtctccctgttccccctctgcctgagcacgacctcccagaagaccacctggctgcccgtgctcctgggcagcctggggtgcaagccgctcacgatgttcctgatcgccgagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcgtgctacgtgatcagcgggtccagcgccgacctgtccctggagaaggccgccgaggtcagctgggaggaggaggccgagcactccggcgcgagccacaacatcctcgtggaggtgcaggacgacgggaccatgaagatcaaggacgaggagcgggacgacaccctgaccatcctgctcaaggccaccctgctggccgtctccggcgtgtacccgctcagcatccccgccacgctgttcgtgtggtacttctggcagaagaagaagcagcgctccggggtcctgtgggacacccccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgcggtgctgatgtaccaggggaagcgcctcgagcccagctgggcctccgtcaagaaggacctgatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctcgacttcaagcccgggacgagcggctcccccatcgtcaaccgcgaggggaagatcgtgggcctgtacggcaacggggtggtcaccaccagcggcacctacgtgagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtccgggaggccatcaagcgcaagctccgcaccctgatcctggcccccacccgggtggtggcctccgagatggcggaggccctcaagggcatgcccatccgctaccagacgaccgccgtcaagagcgagcacaccggcaaggagatcgtggacctgatgtgccacaccacgttcaccatgcggctgctctcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctcaagcccgtgatcctgaaggacgggcccgagcgcgtgatcctggccggccccatgccggtcaccgtggcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtcgagctgatgcgccgcggggacctccccgtgtggctgtcctacaaggtggccagcgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtcatgctgcacaacagcgagcagggcgggcgggcctaccgccacgcgatggaggagctgcccgacacgatcgagaccctcatgctgctggccctcatcgccgtgctgaccggcggggtgaccctgttcttcctctccggccgggggctgggcaagaccagcatcggcctgctctgcgtcatggcctccagcgtgctgctgtggatggcctccgtggagccccactggatcgcggccagcatcatcctcgagttcttcctgatggtcctgctcatccccgagccggaccgccagcggacgccccaggacaaccagctggcctacgtggtgatcgggctcctgttcatgatcctgaccgtcgccgccaacgagatgggcctgctcgagaccaccaagaaggacctggggatcggccacgtggcggtggagaaccaccaccacgccgccatgctggacgtcgacctccaccccgcctccgcctggacgctgtacgcggtggccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtcaaccccctgacgctcaccgccgcggtgctgatgctggtggcccactacgccatcatcggcccggggctccaggccaaggccacccgcgaggcgcagaagcggaccgccgccggcatcatgaagaaccccacggtcgacgggatcgtggccatcgacctggaccccgtggtctacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtgagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtctcccgcggcaccgccaagctgcggtggttcgtggagcgcaacctggtgaagcccgaggggaaggtcatcgacctcggctgcggccgcggcgggtggagctactactgcgccgggctgaagaaggtgacggaggtgaaggggtacaccaagggcggccccggccacgaggagcccatcccgatggccacctacgggtggaacctggtcaagctccactccggcaaggacgtgttcttcatcccgcccgagaagtgcgacaccctgctgtgcgacatcggggagagctcccccaacccgacgatcgaggagggccgcaccctccgggtgctgaagatggtcgagccctggctgcgcgggaaccagttctgcatcaagatcctcaacccctacatgcccagcgtggtggagaccctggagcagatgcagcggaagcacggcggcatgctggtccgcaacccgctctcccggaacagcacccacgagatgtactgggtgtcctgcgggaccggcaacatcgtgagcgccgtcaacatgacgtcccgcatgctgctgaaccgcttcaccatggcgcaccggaagcccacctacgagcgcgacgtggacctcggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtcaacggggtggtcaagctgctcaccaagccctgggacgtgatccccatggtgacccagatcgccatgacggacaccacccccttcggccagcagcgggtcttcaaggagaaggtggacacccgcacgccgaaggccaagcgggggaccgcccagatcatggaggtgaccgccaagtggctgtggggcttcctgtcccgcaacaagaagccccggatctgcacccgcgaggagttcacgcggaaggtccgcagcaacgcggccatcggcgccgtgttcgtggacgagaaccagtggaactccgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtcgagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtggtgcgcgtccagcggcccgccaagaacgggaccgtgatggacgtgatcagccgccgggaccagcgcggctccgggcaggtcggcacgtacggcctgaacaccttcaccaacatggaggcccagctcatccggcagatggagagcgaggggatcttctcccccagcgagctggagacccccaacctggccgagcgcgtgctcgactggctggagaagtacggcgtggagcggctgaagcgcatggccatctccggggacgactgcgtcgtgaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacgagctcgtcggccgggcccgcgtgagccagggggccggctggagcctgcgggagaccgcgtgcctggggaagtcctacgcccagatgtggcagctcatgtacttccaccgccgggacctgcgcctggccgccaacgcgatctgcagcgccgtgcccgtcgactggatccccaccacgtgcaccacctggtccatccacgcccaccaccagtggatgaccacggaggacatgctcagcgtgtggaaccgggtgtggatcgaggagaacccctggatggaggacaagacccacatctccagctggggcgacgtcccgtacctggggaagcgcgaggaccagtggtgcggctccctgatcggcctcaccgcccgcgccacctgggcgaccaacatccaggtggccatcaaccaggtgcggcgcctgatcgggaacgagaactacctggactacatgacgagcatgaagcggttcaagaacgagtccgaccccgagggcgccctctggtga

SEQ ID NO: 8828 - RNA, 9879 nt, synthetic construct
  misc_feature 1..9879: note = derived and/or modified CDS sequence (opt1) from DENV-1__JQ045649__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctgaagctcagctggttcaagaaggggtccagcatcggcaagatgttcgaggccacggcccgcggggcccggcgcatggccatcctgggcgacaccgcgtgggacttcgggtccatcggcggcgtgttcaccagcgtcgggaagctggtgcaccagatcttcggcaccgcctacggggtgctgttctccggcgtcagctggacgatgaagatcgggatcggcgtgctgctgacctggctcggcctgaactcccgcagcacctccctgagcatgacctgcatcgccgtggggctcgtcacgctgtacctgggcgtgatggtgcaggccgactccgggtgcgtcatcaactggaagggccgggagctcaagtgcgggagcggcatcttcgtgaccaacgaggtgcacacctggaccgagcagtacaagttccaggccgacagcccgaagcgcctgtccgcggccatcggcaaggcctgggaggagggggtctgcggcatccggagcgccacccgcctggagaacatcatgtggaagcagatctccaacgagctcaaccacatcctgctggagaacgacatgaagttcacggtggtggtcggggacgtggccggcatcctcgcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctgcgggacagctacacccaggtgtgcgaccaccgcctcatgtccgcggccatcaaggacagcaaggccgtgcacgccgacatgggctactggatcgagtccgagaagaacgagacctggaagctggcccgggcgagcttcatcgaggtcaagacgtgcatctggcccaagtcccacaccctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcacgaccgtggtcgtggacgagcactgcggcaaccgggggccgtccctgcgcaccaccacggtgaccggcaagatcatccacgagtggtgctgccggagctgcaccctgccgcccctccgcttccgcggggaggacggctgctggtacgggatggagatccgccccgtccgggagaaggaggagaacctggtgaagtccatggtgagcgccggcagcggcgaggtcgactccttcagcctcgggctgctgtgcatctccatcatgatcgaggaggtgatgcgcagccggtggtcccgcaagatgctcatgaccggcacgctggccgtgttcttcctgctcatcgtcgggcagctgacctggaacgacctgatccgcctctgcatcatggtgggcgccaacgcgagcgaccggatggggatgggcaccacctacctggccctgatggccacgttcaagatgcgcccgatgttcgccgtgggcctcctgttccggcgcctgacctcccgggaggtcctcctgctgaccatcgggctcagcctggtggcctccgtcgagctgcccaacagcctcgaggagctgggcgacgggctggcgatgggcatcatgatcctcaagctgctgaccgacttccagtcccaccagctctgggccagcctgctgtccctcacgttcatcaagaccaccttcagcctgcactacgcctggaagaccatggccatggtgctgtccgtggtcagcctcttccccctgtgcctgtccacgaccagccagaagaccacctggctccccgtgctgctgggctccctcgggtgcaagccgctgacgatgttcctgatcgcggagaacaagatctggggccgccggagctggcccctcaacgaggggatcatggccgtgggcatcgtcagcatcctgctgtccagcctcctgaagaacgacgtgcccctggccgggcccctcatcgccggcggcatgctgatcgcctgctacgtgatctccgggagctccgcggacctgagcctcgagaaggccgccgaggtctcctgggaggaggaggccgagcacagcggcgcctcccacaacatcctggtggaggtgcaggacgacgggaccatgaagatcaaggacgaggagcgcgacgacaccctgaccatcctcctgaaggcgaccctgctcgccgtcagcggcgtgtacccgctgtccatccccgccacgctgttcgtgtggtacttctggcagaagaagaagcagcggagcggggtcctctgggacacccccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgccgtgctcatgtaccaggggaagcggctggagccctcctgggcgagcgtcaagaaggacctgatctcctacggcggcgggtggcgcctccagggcagctggaacacgggggaggaggtccaggtgatcgccgtcgagcccggcaagaaccccaagaacgtgcagaccgcccccgggaccttcaagacccccgagggcgaggtgggcgccatcgccctggacttcaagcccgggacgtccggcagccccatcgtcaaccgggaggggaagatcgtgggcctgtacggcaacggggtggtcaccaccagcggcacctacgtgtccgcgatcgcccaggccaaggccagccaggaggggccgctccccgagatcgaggacgaggtgttccgcaagcggaacctgacgatcatggacctgcaccccggctccgggaagacccgccggtacctcccggcgatcgtccgcgaggccatcaagcgcaagctgcggaccctgatcctcgcccccacccgcgtggtggccagcgagatggccgaggcgctgaagggcatgcccatccggtaccagacgaccgccgtcaagtccgagcacaccggcaaggagatcgtggacctgatgtgccacgccaccttcacgatgcgcctcctgagccccgtgcgggtcccgaactacaacatgatcatcatggacgaggcccacttcaccgacccctccagcatcgccgcgcgcgggtacatctccacccgggtgggcatgggggaggccgccgccatcttcatgaccgccacgccgcccggcagcgtggaggcgttcccgcagtccaacgccgtcatccaggacgaggagcgcgacatccccgagcggagctggaactccgggtacgagtggatcaccgacttccccggcaagaccgtgtggttcgtgcccagcatcaagtccggcaacgacatcgccaactgcctgcgcaagaacgggaagcgggtcatccagctcagccgcaagaccttcgacacggagtaccagaagaccaagaacaacgactgggactacgtggtgaccaccgacatctccgagatgggcgccaacttccgggcggaccgcgtcatcgacccgcggcgctgcctgaagcccgtgatcctgaaggacgggcccgagcgggtcatcctcgccggccccatgccggtgacggtggccagcgccgcccagcgccgggggcgcatcggccgcaaccacaacaaggagggcgaccagtacatctacatggggcagcccctgaacaacgacgaggaccacgcgcactggaccgaggccaagatgctgctcgacaacatcaacacccccgagggcatcatccccgccctgttcgagccggagcgggagaagtccgccgccatcgacggggagtaccgcctgcggggcgaggcgcgcaagaccttcgtcgagctcatgcggcgcggggacctgcccgtgtggctgagctacaaggtggccagcgagggcttccagtactccgaccggcgctggtgcttcgacggcgagcggaacaaccaggtcctcgaggagaacatggacgtggagatctggacgaaggagggggagcgcaagaagctgcggccccgctggctggacgcccggacctacagcgaccccctcgccctgcgcgagttcaaggagttcgccgcgggccggcgctccgtgagcggggacctgatcctcgagatcggcaagctgccgcagcacctgacccagcgggcccagaacgccctcgacaacctggtcatgctgcacaactccgagcagggcgggcgcgcctaccggcacgcgatggaggagctccccgacaccatcgagacgctgatgctgctcgccctgatcgccgtgctgaccggcggggtgaccctcttcttcctgagcggccgcgggctgggcaagacctccatcggcctcctgtgcgtcatggccagctccgtgctgctctggatggccagcgtggagccccactggatcgcggcctccatcatcctggagttcttcctgatggtcctcctgatccccgagccggaccggcagcgcacgccccaggacaaccagctggcctacgtggtgatcgggctcctgttcatgatcctgacggtcgccgccaacgagatgggcctcctggagaccaccaagaaggacctggggatcggccacgtggcggtggagaaccaccaccacgccgccatgctcgacgtcgacctgcaccccgccagcgcctggaccctgtacgcggtggccacgaccatcatcaccccgatgatgcgccacaccatcgagaacacgaccgccaacatctccctcaccgccatcgccaaccaggcggccatcctgatggggctggacaagggctggcccatcagcaagatggacatcggcgtgcccctcctggccctggggtgctactcccaggtcaaccccctcaccctgacggccgcggtgctgatgctcgtggcccactacgccatcatcggcccggggctgcaggccaaggccacccgggaggcgcagaagcgcaccgccgccggcatcatgaagaaccccaccgtcgacgggatcgtggccatcgacctggaccccgtggtctacgacgccaagttcgagaagcagctcggccagatcatgctgctgatcctctgcacgagccagatcctgctgatgcggaccacctgggcgctctgcgagtccatcaccctggccacgggccccctgaccaccctctgggaggggagcccgggcaagttctggaacaccacgatcgccgtgtccatggccaacatcttccgcgggagctacctggccggcgcgggcctggccttcagcctcatgaagtccctcgggggcgggcggcgcgggaccggggcccagggcgagaccctgggcgagaagtggaagcggcagctcaaccagctgagcaagtccgagttcaacacctacaagcgcagcgggatcatggaggtggaccggtccgaggccaaggagggcctgaagcgcggggagacgaccaagcacgcggtcagccggggcaccgccaagctccgctggttcgtggagcggaacctggtgaagcccgaggggaaggtcatcgacctgggctgcggccgcgggggctggtcctactactgcgccgggctgaagaaggtgaccgaggtgaagggctacacgaagggcgggcccggccacgaggagcccatcccgatggccacctacgggtggaacctcgtcaagctgcacagcggcaaggacgtgttcttcatcccgcccgagaagtgcgacaccctgctctgcgacatcggggagtccagccccaacccgaccatcgaggagggccggacgctgcgcgtgctgaagatggtcgagccctggctccgggggaaccagttctgcatcaagatcctgaacccctacatgccctccgtggtggagaccctggagcagatgcagcgcaagcacggcggcatgctcgtccggaacccgctgagccgcaactccacccacgagatgtactgggtgagctgcgggaccggcaacatcgtgtccgccgtcaacatgaccagccgcatgctgctcaaccggttcacgatggcgcaccgcaagcccacctacgagcgggacgtggacctgggggccggcacccgccacgtggccgtcgagcccgaggtggccaacctggacatcatcggccagcggatcgagaacatcaagcacgagcacaagtccacctggcactacgacgaggacaacccctacaagacgtgggcctaccacgggagctacgaggtcaagccgtccggcagcgcgagctccatggtgaacggggtggtcaagctcctgaccaagccctgggacgtgatccccatggtgacccagatcgccatgaccgacacgacccccttcggccagcagcgcgtcttcaaggagaaggtggacacccggaccccgaaggccaagcgcgggacggcccagatcatggaggtgaccgccaagtggctgtggggcttcctcagccggaacaagaagccccgcatctgcacccgggaggagttcacccgcaaggtccggtccaacgcggccatcggcgccgtgttcgtggacgagaaccagtggaacagcgccaaggaggcggtcgaggacgagcgcttctgggacctggtgcaccgggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcccggttcctggagttcgaggcgctcggcttcatgaacgaggaccactggttcagccgcgagaactccctgagcggggtcgagggcgaggggctgcacaagctcggctacatcctgcgggacatctccaagatccccgggggcaacatgtacgccgacgacaccgccggctgggacacccgcatcaccgaggacgacctgaagaacgaggcccgcatcacggacatcatggagccggagcacgccctcctggccaagtccatcttcaagctgacctaccagaacaaggtggtgcgggtccagcgccccgccaagaacgggaccgtgatggacgtgatctcccggcgcgaccagcggggcagcgggcaggtcggcacctacggcctcaacacgttcaccaacatggaggcccagctgatccgccagatggagtccgaggggatcttcagcccctccgagctggagacccccaacctcgccgagcgggtgctgcactggctggagaagtacggcgtggagcgcctcaagcggatggccatcagcggggacgactgcgtcgtgaagccgatcgacgaccgcttcgcgaccgccctgacggccctgaacgacatgggcaaggtgcggaaggacatcccccagtgggagccctccaaggggtggaacgactggcagcaggtccccttctgcagccaccacttccaccagctcatcatgaaggacggccgcgagatcgtggtgccgtgccggaaccaggacgagctggtcggccgcgcccgggtgagccagggggccggctggtccctgcgcgagaccgcgtgcctcggcaagagctacgcccagatgtggcagctgatgtacttccaccggcgcgacctgcggctcgccgccaacgcgatctgctccgccgtgcccgtcgactggatccccaccagccgcaccacgtggtccatccacgcccaccaccagtggatgaccaccgaggacatgctgagcgtgtggaaccgcgtgtggatcgaggagaacccctggatggaggacaagacccacatctccagctggggcgacgtcccgtacctggggaagcgggaggaccagtggtgcggctccctcatcggcctgacggcccgcgccacctgggcgaccaacatccaggtggccatcaaccaggtgcggcgcctgatcgggaacgagaactacctcgactacatgaccagcatgaagcggttcaagaacgagtccgaccccgagggcgccctgtggtga

SEQ ID NO: 8829 - RNA, 9879 nt, synthetic construct
  misc_feature 1..9879: note = derived and/or modified CDS sequence (opt1) from DENV-1__JQ045650__SS-prME
  source 1..9879: mol_type = other RNA
tccgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacacgatgacctacaagtgcccccgcatcaccgagaccgagcccgacgacgtggactgctggtgcaacgccacggacacctgggtcacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgcgggagaaggaggagaacctcgtcaagtccatggtgagcgccggcagcggcgaggtggactccttcagcctggggctgctctgcatctccatcatgatcgaggaggtcatgcgcagccggtggtcccgcaagatgctgatgaccggcacgctggccgtgttcttcctcctgatcgtggggcagctgacctggaacgacctcatccgcctgtgcatcatggtcggcgccaacgcgagcgaccggatggggatgggcaccacctacctggccctcatggccacgttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccagcctgctctccctgacgttcatcaagaccaccttcagcctgcactacgcctggaagaccatggccatggtcctctccgtggtgagcctgttccccctgtgcctctccacgaccagccagaagaccacctggctgcccgtcctgctcggctccctggggtgcaagccgctgacgatgttcctcatcgcggagaacaagatctggggccgccggagctggcccctgaacgaggggatcatggccgtgggcatcgtgagcatcctgctctccagcctgctgaagaacgacgtccccctcgccgggcccctgatcgccggcggcatgctgatcgcctgctacgtgatctccgggagctccgcggacctcagcctggagaaggccgccgaggtgtcctgggaggaggaggccgagcacagcggcgcctcccacaacatcctggtcgaggtgcaggacgacgggaccatgaagatcaaggacgaggagcgcgacgacaccctcaccatcctgctgaaggcgaccctcctggccgtgagcggcgtctacccgctgtccatccccgccaccctgttcgtgtggtacttctggcagaagaagaagcagcggagcggggtgctgtgggacacccccagcccgcccgaggtcgagcgcgccgtgctggacgacggcatctaccggatcatgcagcgcggcctgctcgggcggagccaggtgggcgtcggggtgttccaggagaacgtgttccacaccatgtggcacgtcacccgcggcgccgtgctgatgtaccaggggaagcggctggagccctcctgggcgagcgtgaagaaggacctcatctcctacggcggcgggtggcgcctgcagggcagctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgtccggcagccccatcgtgaaccgggaggggaagatcgtcggcctctacggcaacggggtggtgaccaccagcggcacctacgtctccgcgatcgcccaggccaaggccagccaggaggggccgctgcccgagatcgaggacgaggtgttccgcaagcggaacctgacgatcatggacctccaccccggctccgggaagacccgccggtacctgccggcgatcgtgcgcgaggccatcaagcgcaagctgcggaccctcatcctggcccccacccgcgtcgtggccagcgagatggccgaggcgctgaagggcatgcccatccggtaccagacgaccgccgtgaagtccgagcacaccggcaaggagatcgtcgacctcatgtgccacgccaccttcacgatgcgcctgctgagccccgtgcgggtgccgaactacaacatgatcatcatggacgaggcccacttcaccgacccctccagcatcgccgcgcgcgggtacatctccacccgggtcggcatgggggaggccgccgccatcttcatgaccgccacgccgcccggcagcgtggaggcgttcccgcagtccaacgccgtgatccaggacgaggagcgcgacatccccgagcggagctggaactccgggtacgagtggatcaccgacttccccggcaagaccgtctggttcgtgcccagcatcaagtccggcaacgacatcgccaactgcctccgcaagaacgggaagcgggtgatccagctgagccgcaagaccttcgacacggagtaccagaagaccaagaacaacgactgggactacgtcgtgaccaccgacatctccgagatgggcgccaacttccgggcggaccgcgtgatcgacccgcggcgctgcctgaagcccgtcatcctcaaggacgggcccgagcgggtgatcctggccggccccatgccggtcacggtggccagcgccgcccagcgccgggggcgcatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgggagaagtccgccgccatcgacggggagtaccgcctccggggcgaggcgcgcaagaccttcgtggagctgatgcggcgcggggacctgcccgtctggctcagctacaaggtggccagcgagggcttccagtactccgaccggcgctggtgcttcgacggcgagcggaacaaccaggtgctggaggagaacatggacgtcgagatctggacgaaggagggggagcgcaagaagctgcggccccgctggctcgacgcccggacctacagcgaccccctggccctgcgcgagttcaaggagttcgccgcgggccggcgctccgtgagcggggacctcatcctggagatcggcaagctgccgcagcacctcacccagcgggcccagaacgccctggacaacctggtgatgctccacaactccgagcagggcgggcgcgcctaccggcacgcgatggaggagctgcccgacaccatcgagacgctgatgctcctggccctgatcgccgtcctcaccggcggggtgaccctgttcttcctgagcggccgcgggctcggcaagacctccatcggcctgctgtgcgtgatggccagctccgtcctcctgtggatggccagcgtggagccccactggatcgcggcctccatcatcctggagttcttcctcatggtgctgctgatccccgagccggaccggcagcgcacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccgccatgctggacgtggacctgcaccccgccagcgcctggaccctctacgcggtcgccacgaccatcatcaccccgatgatgcgccacaccatcgagaacacgaccgccaacatctccctgaccgccatcgccaaccaggcggccatcctgatggggctcgacaagggctggcccatcagcaagatggacatcggcgtgcccctgctggccctcgggtgctactcccaggtgaaccccctgaccctgacggccgcggtcctcatgctggtggcccactacgccatcatcggcccggggctgcaggccaaggccacccgggaggcgcagaagcgcaccgccgccggcatcatgaagaaccccaccgtggacgggatcgtcgccatcgacctcgaccccgtggtgtacgacgccaagttcgagaagcagctgggccagatcatgctgctcatcctgtgcacgagccagatcctgctcatgcggaccacctgggcgctgtgcgagtccatcaccctggccacgggccccctcaccaccctgtgggaggggagcccgggcaagttctggaacaccacgatcgccgtctccatggccaacatcttccgcgggagctacctggccggcgcgggcctcgccttcagcctgatgaagtccctcgggggcgggcggcgcgggaccggggcccagggcgagaccctcggcgagaagtggaagcggcagctgaaccagctgagcaagtccgagttcaacacctacaagcgcagcgggatcatggaggtggaccggtccgaggccaaggagggcctcaagcgcggggagacgaccaagcacgcggtgagccggggcaccgccaagctgcgctggttcgtcgagcggaacctggtgaagcccgaggggaaggtgatcgacctgggctgcggccgcgggggctgggcctactactgcgccgggctcaagaaggtcaccgaggtgaagggctacacgaagggcggccccggccacgaggagcccatcccgatggccacctacgggtggaacctggtgaagctgcactccggcaaggacgtcttcttcatcccgcccgagaagtgcgacaccctcctgtgcgacatcggggagagctcccccaacccgaccatcgaggagggccggacgctgcgcgtgctcaagatggtggagccctggctgcgggggaaccagttctgcatcaagatcctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgcggtgaacatgacctcccgcatgctcctgaaccggttcacgatggcccaccgcaagcccacctacgagcgggacgtcgacctgggggccggcacccgccacgtggccgtggagcccgaggtcgccaacctcgacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctgctgaccaagccctgggacgtcatccccatggtgacccagatcgccatgaccgacacgacccccttcggccagcagcgcgtgttcaaggagaaggtcgacacccggaccccgaaggccaagcgcgggacggcccagatcatggaggtgaccgcgaagtggctctggggcttcctgtcccggaacaagaagccccgcatctgcacccgggaggagttcacccgcaaggtgcggagcaacgccgccatcggcgccgtcttcgtggacgagaaccagtggaactccgcgaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggccaaggggagccgcgccatctggtacatgtggctgggcgcgcggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgccggctgggacacccgcatcaccgaggacgacctcaagaacgaggcccgcatcacggacatcatggagccggagcacgcgctgctggccaagtccatcttcaagctcacctaccagaacaaggtcgtgcgggtgcagcgccccgccaagaacgggaccgtcatggacgtgatcagccggcgcgaccagcggggctccggccaggtggggacctacggcctgaacacgttcaccaacatggaggcccagctgatccgccagatggagagcgaggggatcttctcccccagcgagctcgagacccccaacctggccgagcgggtcctgcactggctcgagaagtacggcgtggagcgcctgaagcggatggcgatctccggggacgactgcgtggtcaagccgatcgacgaccgcttcgccaccgccctgacggccctcaacgacatgggcaaggtgcggaaggacatcccccagtgggagcccagcaaggggtggaacgactggcagcaggtccccttctgctcccaccacttccaccagctgatcatgaaggacggccgcgagatcgtcgtgccgtgccggaaccaggacgagctggtgggccgcgcccgggtcagccagggggcgggctggagcctccgcgagaccgcctgcctggggaagtcctacgcccagatgtggcagctgatgtacttccaccggcgcgacctccggctggccgcgaacgccatctgcagcgccgtgcccgtggactggatccccacctcccgcaccacgtggagcatccacgcccaccaccagtggatgaccaccgaggacatgctgtccgtctggaaccgcgtgtggatcgaggagaacccctggatggaggacaagacccacatcagctcctggggcgacgtgccgtacctcgggaagcgggaggaccagtggtgcggcagcctgatcggcctgacggcccgcgcgacctgggccaccaacatccaggtcgccatcaaccaggtgcggcgcctcatcgggaacgagaactacctggactacatgacctccatgaagcggttcaagaacgagagcgaccccgagggcgccctgtggtga

SEQ ID NO: 8830 - RNA, 9879 nt, synthetic construct
  misc_feature 1..9879: note = derived and/or modified CDS sequence (opt1) from DENV-1__JQ045651__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagtacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcgtgccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggccatctccggggacgactgcgtggtgaagccgatcgacgaccggttcgcgacggccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctgggaggacgtgccgtacctcggcaagcgcgaggaccagtggtgcgggagcctgatcggcctgaccgcccgggccacctgggcgaccaacatccaggtggccatcaaccaggtccgccggctcatcggcaacgagaactacctggactacatgacctccatgaagcgcttcaagaacgagagcgaccccgagggggccctgtggtga

SEQ ID NO: 8831 - RNA, 9879 nt, synthetic construct
  misc_feature 1..9879: note = derived and/or modified CDS sequence (opt1) from DENV-1__JQ045652__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgccccacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcacgaccgtggtggtcgacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcacgctggccgtgttcttcctcctgatcatggggcagctgacctggaacgacctcatccgcctgtgcatcatggtgggcgccaacgcgagcgaccgcatggggatgggcaccacctacctggccctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcaccgacttccagtcccaccagctgtgggccacgctgctcagcctgaccttcatcaagaccaccttctccctgcactacgcctggaagacgatggccatggtgctcagcatcgtctccctgttccccctgtgcctcagcaccacctcccagaagaccacgtggctgcccgtgctgctcggcagcctggggtgcaagccgctgaccatgttcctcatcgcggagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcctgctacgtgatcagcgggtccagcgcggacctctccctggagaaggccgccgaggtcagctgggaggaggaggccgagcactccggcgccagccacaacatcctggtggaggtgcaggacgacgggaccatgaagatcaaggacgaggagcgggacgacaccctcaccatcctgctgaaggcgacgctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacgcggggcgccgtgctgatgtaccaggggaagcgcctggagcccagctgggcgtccgtcaagaaggacctcatcagctacggcggcgggtggcggctgcagggctcctggaacaccggggaggaggtccaggtgatcgccgtcgagcccggcaagaaccccaagaacgtgcagaccgcccccgggaccttcaagacgcccgagggcgaggtgggcgccatcgccctggacttcaagcccgggaccagcggctcccccatcgtcaaccgcgaggggaagatcgtgggcctctacggcaacggggtggtcaccaccagcggcacgtacgtgagcgcgatcgcccaggccaaggcctcccaggaggggccgctgcccgagatcgaggacgaggtgttccggaagcgcaacctgaccatcatggacctccaccccggcagcgggaagacccggcgctacctgccggcgatcgtccgggaggccatcaagcgcaagctgcgcaccctcatcctggcccccacgcgggtggtggcctccgagatggccgaggcgctgaagggcatgcccatccgctaccagaccaccgccgtcaagagcgagcacaccggcaaggagatcgtggacctcatgtgccacgccacgttcaccatgcggctgctgtcccccgtgcgcgtcccgaactacaacatgatcatcatggacgaggcccacttcaccgaccccagctccatcgccgcgcgggggtacatcagcacccgcgtgggcatgggggaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccgcgccggtgcctgaagcccgtgatcctcaaggacgggcccgagcgcgtgatcctggccggccccatgccggtcaccgtggcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccggctccgcggcgaggcgcggaagacgttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtgtccggggacctcatcctggagatcggcaagctgccgcagcacctcacccagcgcgcccagaacgccctggacaacctggtcatgctccacaacagcgagcagggcgggcgggcctaccgccacgcgatggaggagctgcccgacacgatcgagaccctgatgctcctggccctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgcggccagcatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggtggagaaccaccaccacgccgccatgctggacgtcgacctgcaccccgcctccgcctggacgctctacgcggtggccaccaccatcatcaccccgatgatgcgccacacgatcgagaacaccaccgccaacatcagcctgaccgccatcgccaaccaggcggccatcctgatggggctcgacaagggctggcccatctccaagatggacatcggcgtgcccctgctggccctcgggtgctacagccaggtcaaccccctgacgctgaccgccgcggtgctcatgctggtggcccactacgccatcatcggcccggggctgcaggccaaggccacccgcgaggcgcagaagcggaccgccgccggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggcgctgtgcgagagcatcacgctggccaccggccccctcaccaccctgtgggaggggtccccgggcaagttctggaacacgaccatcgccgtgagcatggccaacatcttccgggggtcctacctggccggcgcgggcctcgccttcagcctgatgaagtccctcgggggcgggcgccgggggaccggggcccagggcgagaccctcggcgagaagtggaagcgccagctgaaccagctgtccaagagcgagttcaacacgtacaagcggtccgggatcatggaggtggaccgcagcgaggccaaggagggcctcaagcgcggggagaccaccaagtacgcggtctcccgcggcaccgccaagctgcggtggttcgtggagcgcaacctggtgaagcccgaggggaaggtcatcgacctgggctgcggccgcgggggctggagctactactgcgccgggctcaagaaggtgacggaggtgaagggctacaccaagggcggccccggccacgaggagcccatcccgatggccacctacgggtggaacctggtcaagctgcactccggcaaggacgtgttcttcgtgccgcccgagaagtgcgacaccctcctgtgcgacatcggggagagctcccccaacccgacgatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggaccggcaacatcgtcagcgccgtgaacatgacgtcccgcatgctcctgaaccgcttcaccatggcgcaccggaagcccacctacgagcgcgacgtggacctgggggccggcacccggcacgtcgccgtggagcccgaggtggccaacctcgacatcatcggccagcgcatcgagaacatcaagcacgagcacaagagcacgtggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgccaagtggctctggggcttcctgtcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggcccgcatcaccgacatcatggagccggagcacgccctgctggcgaagtccatcttcaagctcacctaccagaacaaggtggtccgcgtgcagcggcccgccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggccatctccggggacgactgcgtggtgaagccgatcgacgaccggttcgcgacggccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtccccgtggactggatccccacctcccggacgacctggagcatccacgcccaccaccagtggatgaccaccgaggacatgctgtccgtgtggaaccgcgtctggatcgaggagaacccctggatggaggacaagacgcacatcagctcctggggcgacgtgccgtacctcgggaagcgcgaggaccagtggtgcggcagcctgatcggcctgaccgcccgggccacctgggcgaccaacatccaggtggccatcaaccaggtccgccggctcatcgggaacgagaactacctggactacatgacctccatgaagcgcttcaagaacgagagcgaccccgagggcgccctgtggtga

SEQ ID NO: 8832 - RNA, 9879 nt, synthetic construct
  misc_feature 1..9879: note = derived and/or modified CDS sequence (opt1) from DENV-1__JQ045653__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccggaccgagacctggatgagctccgagggcgcctggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgctggtggaccggggctgggggaacggctgcggcctgttcggcaaggggtccctgatcacgtgcgccaagttcaagtgcgtgaccaagctggagggcaagatcgtccagtacgagaacctcaagtacagcgtgatcgtgaccgtccacacgggcgaccagcaccaggtggggaacgagtccaccgagcacggcaccaccgccaccatcacgccccaggcgcccaccaccgagatccagctgaccgactacggggccctgacgctcgactgcagcccccgcaccggcctggacttcaacgagatggtcctgctcaccatgaaggagaagtcctggctggtgcacaagcagtggttcctggacctccccctgccctggaccagcggggccagcacgtcccaggagacctggaaccggcaggacctgctcgtgaccttcaagaccgcccacgccaagaagcaggaggtcgtggtgctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggagctggccgagacccagcacggcaccgtgctggtgcagatcaagtacgagggcaccgacgcgccctgcaagatccccttcagcacgcaggacgagaagggggtcacccagaacggccggctcatcaccgccaacccgatcgtgaccgacaaggagaagcccgtgaacatcgaggccgagccgcccttcggggagtcctacatcgtcatcggcgccggcgagaaggcgctgaagctgagctggttcaagaaggggtccagcatcggcaagatgttcgaggccacggcccgcggggcccggcgcatggccatcctcggcgacaccgcgtgggacttcgggtccatcggcggcgtgttcaccagcgtggggaagctggtccaccagatcttcggcaccgcctacggggtgctgttctccggcgtgagctggacgatgaagatcgggatcggcgtcctcctgacctggctgggcctcaactcccgcagcacctccctgagcatgacctgcatcgccgtggggctggtgacgctctacctgggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctctccgcggccatcggcaaggcctgggaggagggggtgtgcggcatccggagcgccacccgcctggagaacatcatgtggaagcagatctccaacgagctgaaccacatcctcctggagaacgacatgaagttcacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctcaagctgcgggacagctacacccaggtctgcgaccaccgcctgatgtccgcggccatcaaggacagcaaggccgtgcacgccgacatgggctactggatcgagtccgagaagaacgagacctggaagctcgcccgggcgagcttcatcgaggtgaagacgtgcatctggccccgctcccacaccctgtggagcaacggcgtcctggagtccgagatgatcatccccaagatctacgggggcccgatcagccagcacaactaccggcccgggtacttcacccagaccgccggcccctggcacctcgggaagctggagctggacttcgacctctgcgagggcacgaccgtggtggtcgacgagcactgcggcaaccgcgggccgtccctgcggaccaccacggtgaccggcaagatcatccacgagtggtgctgccgcagctgcaccctgccgcccctgcggttccgcggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccggtggtccaagaagatgctgatgaccggcacgctcgccgtgttcttcctgctgatcatggggcagctcacctggaacgacctgatccgcctgtgcatcatggtgggcgccaacgcgagcgaccgcatggggatgggcaccacctacctcgccctgatggccacgttcaagatgcggccgatgttcgccgtcgggctcctcttccgccggctgacctcccgcgaggtgctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccacgctcctgagcctgaccttcatcaagaccaccttctccctccactgcgcctggaagacgatggccatgatcctgagcatcgtgtccctgttccccctctgcctgagcaccacctcccagaagaccacgtggctgcccgtcctcctgggcagcctggggtgcaagccgctcaccatgttcctgatcgcggagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcctgctacgtgatcagcgggtccagcgcggacctgtccctggagaaggccgccgaggtgagctgggaggaggaggccgagcactccggcgccagccacaacatcctcgtcgaggtgcaggacgacgggaccatgaagatcaaggacgaggagcgggacgacaccctgaccatcctgctcaaggcgacgctgctggccgtgtccggcgtctacccgctcagcatccccgccaccctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggaggacgtgttccacaccatgtggcacgtcacgcggggcgccgtgctgatgtaccaggggaagcgcctcgagcccagctgggcgtccgtgaagaaggacctgatcagctacggcggcgggtggcggctgcagggctcctggaacaccggggaggaggtccaggtgatcgccgtggagcccggcaagaaccccaagaacgtccagaccgcccccgggaccttcaagacgcccgagggcgaggtgggcgccatcgccctcgacttcaagcccgggaccagcggctcccccatcgtgaaccgcgaggggaagatcgtcggcctgtacggcaacggggtggtgaccaccagcggcacgtacgtcagcgcgatcgcccaggccaaggcctcccaggaggggccgctgcccgagatcgaggacgaggtgttccggaagcgcaacctcaccatcatggacctgcaccccggcagcgggaagacccggcgctacctgccggcgatcgtgcgggaggccatcaagcgcaagctccgcaccctgatcctggcccccacgcgggtcgtggcctccgagatggccgaggcgctcaagggcatgcccatccgctaccagaccaccgccgtcaagagcgagcacaccggcaaggagatcgtcgacctgatgtgccacgccacgttcaccatgcggctgctctcccccgtgcgcgtgccgaactacaacatgatcatcatggacgaggcccacttcaccgaccccagctccatcgccgcgcgggggtacatcagcacccgcgtcggcatgggggaggccgccgccatcttcatgacggccacgccgcccggctccgtggaggcgttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagacgttcgacaccgagtaccagaagaccaagaacaacgactgggactacgtcgtgaccacggacatcagcgagatgggcgccaacttccgcgcggaccgggtgatcgacccgcgccggtgcctcaagcccgtcatcctgaaggacgggcccgagcgcgtgatcctggccggccccatgccggtgaccgtcgcctccgccgcccagcggcgcgggcggatcggccgcaaccacaacaaggagggcgaccagtacatctacatggggcagcccctcaacaacgacgaggaccacgcgcactggaccgaggccaagatgctgctggacaacatcaacacccccgagggcatcatccccgccctcttcgagccggagcgcgagaagtccgccgccatcgacggggagtaccggctgcgcggcgaggcgcggaagacgttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccgcagcacctgacccagcgcgcccagaacgccctggacaacctcgtgatgctgcacaacagcgagcagggcgggcgggcctaccgccacgcgatggaggagctgcccgacacgatcgagaccctcatgctgctggccctcatcgccgtcctgaccggcggggtgaccctgttcttcctctccggccgggggctgggcaagaccagcatcggcctgctctgcgtgatggcctccagcgtcctgctgtggatggcctccgtggagccccactggatcgcggccagcatcatcctcgagttcttcctgatggtgctgctcatccccgagccggaccgccagcggacgccccaggacaaccagctggcctacgtcgtgatcgggctcctcttcatgatcctgaccgtggccgccaacgagatgggcctgctcgagaccaccaagaaggacctggggatcggccacgtcgcggtggagaaccaccaccacgccgccatgctggacgtggacctccaccccgcctccgcctggacgctgtacgcggtcgccaccaccatcatcaccccgatgatgcgccacacgatcgagaacaccaccgccaacatcagcctgaccgccatcgccaaccaggcggccatcctcatggggctggacaagggctggcccatctccaagatggacatcggcgtgcccctgctcgccctggggtgctacagccaggtgaaccccctgacgctcaccgccgcggtcctgatgctggtggcccactacgccatcatcggcccggggctccaggccaaggccacccgcgaggcgcagaagcggaccgccgccggcatcatgaagaaccccacggtggacgggatcgtcgccatcgacctggaccccgtggtgtacgacgccaagttcgagaagcagctgggccagatcatgctcctgatcctgtgcacctcccagatcctcctgatgcgcaccacctgggcgctgtgcgagagcatcacgctcgccaccggccccctgaccaccctgtgggaggggtccccgggcaagttctggaacacgaccatcgccgtcagcatggccaacatcttccgggggtcctacctcgccggcgcgggcctggccttcagcctgatgaagtccctcgggggcgggcgccggggcaccggggcccagggcgagaccctgggcgagaagtggaagcgccagctgaaccagctctccaagagcgagttcaacacgtacaagcggtccgggatcatggaggtggaccgcagcgaggccaaggagggcctgaagcgcggggagaccaccaagcacgcggtgtcccgcggcaccgccaagctgcggtggttcgtcgagcgcaacctggtgaagcccgaggggaaggtgatcgacctcggctgcggccgcggcgggtggagctactactgcgccgggctgaagaaggtcacggaggtgaaggggtacaccaagggcgggcccggccacgaggagcccatcccgatggccacctacgggtggaacctggtgaagctccactccggcaaggacgtcttcttcatcccgcccgagaagtgcgacaccctgctgtgcgacatcggggagagctcccccaacccgacgatcgaggagggccgcaccctccgggtgctgaagatggtggagccctggctgcgcgggaaccagttctgcatcaagatcctcaacccctacatgcccagcgtcgtggagaccctggagcagatgcagcggaagcacggcggcatgctggtgcgcaacccgctctcccggaacagcacccacgagatgtactgggtctcctgcgggaccggcaacatcgtgagcgccgtgaacatgacgtcccgcatgctgctgaaccgcttcaccatggcgcaccggaagcccacctacgagcgcgacgtcgacctcggggccggcacccggcacgtggccgtggagcccgaggtcgccaacctggacatcatcggccagcgcatcgagaacatcaagcacgagcacaagagcacgtggcactacgacgaggacaacccctacaagacctgggcctaccacgggtcctacgaggtgaagccgagcggctccgcgagcagcatggtgaacggggtcgtgaagctgctcaccaagccctgggacgtcatccccatggtgacccagatcgccatgacggacaccacccccttcggccagcagcgggtgttcaaggagaaggtcgacacccgcacgccgaaggccaagcgggggaccgcccagatcatggaggtgaccgccaagtggctgtggggcttcctgtcccgcaacaagaagccccggatctgcacccgcgaggagttcacgcggaaggtgcgcagcaacgcggccatcggcgccgtcttcgtggacgagaaccagtggaactccgccaaggaggcggtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcccgcttcctggagttcgaggcgctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagccggagcacgccctgctcgcgaagtccatcttcaagctgacctaccagaacaaggtcgtgcgcgtgcagcggcccgccaagaacgggaccgtcatggacgtgatcagccgccgggaccagcgcggctccggccaggtgggcacgtacggcctgaacaccttcaccaacatggaggcccagctcatccggcagatggagagcgaggggatcttctcccccagcgagctggagacccccaacctggccgagcgcgtcctcgactggctggagaagtacggcgtggagcggctgaagcgcatggccatctccggggacgactgcgtggtcaagccgatcgacgaccggttcgcgacggccctcaccgccctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggagcctgcgggagaccgcgtgcctggggaagtcctacgcccagatgtggcagctcatgtacttccaccgccgggacctgcgcctggccgccaacgcgatctgcagcgccgtgcccgtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccgtacctggggaagcgcgaggaccagtggtgcggcagcctgatcggcctcaccgcccgggccacctgggcgaccaacatccaggtcgccatcaaccaggtgcgccggctgatcgggaacgagaactacctggactacatgacctccatgaagcgcttcaagaacgagagcgaccccgagggcgccctctggtga

SEQ ID NO: 8833 - RNA, 9879 nt, synthetic construct
  misc_feature 1..9879: note = derived and/or modified CDS sequence (opt1) from DENV-1__JQ045657__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagttctgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcatccggtccaccacccgcctggagaacatcatgtggaagcagatcagcaacgagctgaaccacatcctcctggagaacgacatgaagttcaccgtggtggtcggggacgtggccggcatcctggcgcaggggaagaagatgatccggccccagcccatggagtacaagtactcctggaagtcctggggcaaggccaagatcatcggcgccgacgtgcagaacacgaccttcatcatcgacgggcccaacaccccggagtgccccgacgaccagcgcgcctggaacatctgggaggtcgaggactacggcttcgggatcttcaccacgaacatctggctcaagctgcgggactcctacacccaggtgtgcgaccaccgcctgatgagcgcggccatcaaggactccaaggccgtgcacgccgacatgggctactggatcgagagcgagaagaacgagacctggaagctcgcccgggcgtccttcatcgaggtcaagacctgcatctggcccaagagccacacgctgtggtccaacggcgtgctggagagcgagatgatcatccccaagatctacgggggcccgatctcccagcacaactaccgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgccggctccggcgaggtcgacagcttctccctggggctcctgtgcatcagcatcatgatcgaggaggtgatgcgctcccggtggagccgcaagatgctgatgaccggcaccctcgccgtgttcttcctgctgatcatggggcagctcacgtggaacgacctgatccggctgtgcatcatggtcggcgccaacgcgtccgaccgcatggggatgggcaccacctacctcgccctgatggccaccttcaagatgcgcccgatgttcgccgtgggcctcctgttccggcgcctgacgagccgggaggtgctgctcctgaccatcgggctgtccctcgtcgccagcgtggagctgcccaactccctggaggagctcggcgacgggctggcgatgggcatcatgatcctgaagctcctgaccgacttccagagccaccagctgtgggccaccctcctgtccctgacgttcatcaagaccaccttcagcctccactacgcctggaagaccatggccatggtcctgtccatcgtgagcctgttccccctctgcctgtccacgaccagccagaagaccacctggctgcccgtgctcctgggctccctggggtgcaagccgctcacgatgttcctgatcgcggagaacaagatctggggccgcaagagctggcccctgaacgaggggatcatggccgtcggcatcgtgagcatcctcctgtccagcctgctcaagaacgacgtgcccctggccgggcccctgatcgccggcggcatgctcatcgcctgctacgtcatctccgggagctccgcggacctgagcctggagaaggccgccgaggtgtcctgggaggaggaggccgagcacagcggcgcctcccacaacatcctcgtggaggtccaggacgacgggaccatgaagatcaaggacgaggagcgggacgacaccctgaccatcctgctcaaggcgaccctgctggccgtgagcggcgtgtacccgctctccatccccgccacgctgttcgtctggtacttctggcagaagaagaagcagcgcagcggggtgctgtgggacacccccagcccgcccgaggtggagcgggccgtcctcgacgacggcatctaccgcatcatgcagcggggcctgctggggcgcagccaggtgggcgtgggggtcttccaggagaacgtgttccacaccatgtggcacgtgacccggggcgccgtcctgatgtaccaggggaagcgcctcgagccctcctgggcgagcgtgaagaaggacctgatctcctacggcggcgggtggcggctgcagggcagctggaacacgggggaggaggtgcaggtcatcgccgtggagcccggcaagaaccccaagaacgtgcagaccgcccccgggaccttcaagacctccgagggcgaggtcggcgccatcgccctcgacttcaagcccgggacgagcggcagccccatcgtgaaccgcgaggggaagatcgtgggcctgtacggcaacggggtcgtgaccacctccggcacctacgtgagcgcgatcgcccaggccaaggcctcccaggaggggcccctgccggagatcgaggacgaggtcttccggaagcgcaacctcacgatcatggacctgcaccccggcagcgggaagacccggcgctacctgcccgcgatcgtgcgggaggccatcaagcgcaagctccggaccctgatcctggccccgacccgcgtggtcgcctccgagatggccgaggcgctcaagggcatgcccatccgctaccagacgaccgccgtcaagagcgagcacaccggcaaggagatcgtggacctgatgtgccacgccaccttcacgatgcggctgctctcccccgtccgcgtgcccaactacaacatgatcatcatggacgaggcccacttcaccgacccgagctccatcgccgcgcgggggtacatcagcacccgcgtgggcatgggggaggccgccgccatcttcatgaccgccacgccgcccggctccgtcgaggcgttcccccagagcaacgccgtgatccaggacgaggagcgggacatcccggagcgctcctggaacagcgggtacgagtggatcaccgacttccccggcaagaccgtgtggttcgtcccctccatcaagagcggcaacgacatcgccaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgcggaccgggtgatcgacccccgccggtgcctcaagccggtgatcctgaaggacgggcccgagcgcgtcatcctggccggccccatgcccgtgacggtcgcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgggagaagtccgccgccatcgacggggagtaccgcctgcgcggcgaggcgcggaagaccttcgtggagctgatgcgccgcggggacctcccggtgtggctgagctacaaggtcgcctccgagggcttccagtacagcgaccgccggtggtgcttcgacggcgagcgcaacaaccaggtgctggaggagaacatggacgtggagatctggacgaaggagggggagcggaagaagctccgcccccggtggctggacgcccgcacctactccgaccccctggccctccgggagttcaaggagttcgccgcgggccgccggagcgtctccggggacctgatcctggagatcggcaagctcccccagcacctgacccagcgcgcccagaacgccctggacaacctcgtgatgctgcacaacagcgagcagggcgggcgggcctaccgccacgcgatggaggagctgccggacaccatcgagacgctcatgctgctggccctcatcgccgtgctgaccggcggggtcaccctgttcttcctctccggccgggggctgggcaagaccagcatcggcctgctctgcgtgatggcctccagcgtgctgctgtggatggcctccgtcgagccccactggatcgcggccagcatcatcctcgagttcttcctgatggtgctgctcatccccgagcccgaccgccagcggaccccgcaggacaaccagctggcctacgtggtcatcgggctcctcttcatgatcctgacggtggccgccaacgagatgggcctgctcgagaccaccaagaaggacctggggatcggccacgtggcggccgagaaccaccaccacgccgccatgctggacgtcgacctccaccccgcctccgcgtggaccctgtacgccgtggccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtcaaccccctgaccctcacggcggccgtgctgatgctggtggcccactacgccatcatcggccccgggctccaggccaaggcgacccgggaggcccagaagcgcaccgccgccggcatcatgaagaacccgaccgtcgacgggatcgtggccatcgacctggaccccgtggtctacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtgagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagacgaccaagcacgccgtctcccgcggcaccgccaagctgcggtggttcgtggagcgcaacctcgtgaagccggaggggaaggtcatcgacctgggctgcggccgcggcgggtggagctactactgcgccgggctgaagaaggtgaccgaggtgaaggggtacacgaagggcgggcccggccacgaggagcccatccccatggccacctacgggtggaacctggtcaagctccactccggcaaggacgtgttcttcgtgccgcccgagaagtgcgacaccctgctgtgcgacatcggggagagctcccccaaccccaccatcgaggagggccgcacgctccgggtcctgaagatggtggagccgtggctgcgcgggaaccagttctgcatcaagatcctcaacccctacatgcccagcgtggtcgagaccctggagcagatgcagcggaagcacggcggcatgctggtgcgcaaccccctctcccggaacagcacccacgagatgtactgggtgtcctgcgggaccggcaacatcgtcagcgcggtgaacatgacctcccgcatgctgctgaaccggttcacgatggcccaccgcaagccgacctacgagcgcgacgtggacctcggggccggcacccggcacgtcgccgtggagcccgaggtggccaacctggacatcatcggccagcgcatcgagaacatcaagcacgagcacaagagcacctggcactacgacgaggacaacccctacaagacgtgggcgtaccacgggtcctacgaggtcaagcccagcggcagcgcctccagcatggtgaacggggtcgtgaagctgctcaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgaagtggctgtggggcttcctgtcccgcaacaagaagccgcggatctgcacccgcgaggagttcacccggaaggtgcgcagcaacgccgccatcggcgccgtgttcgtcgacgagaaccagtggaactccgcgaaggaggccgtggaggacgagcggttctgggacctcgtgcaccgcgagcgggagctgcacaagcaggggaagtgcgccacgtgcgtctacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcaccgaggacgacctgcagaacgaggcccgcatcacggacatcatggagcccgagcacgcgctgctcgccaagtccatcttcaagctgacctaccagaacaaggtggtccgggtgcagcgcccggccaagaacgggaccgtgatggacgtcatcagccgccgggaccagcgcggctccggccaggtgggcacctacggcctgaacacgttcaccaacatggaggcccagctcatccggcagatggagagcgaggagatcttctcccccagcgagctggagacccccaacctggccgggcgcgtgctcgactggctggagaagcacggcgtcgagcggctgaagcgcatggcgatctccggggacgactgcgtggtgaagcccatcgacgaccggttcgccaccgccctcacggccctgaacgacatgggcaaggtccgcaaggacatcccgcagtgggagcccagcaaggggtggaacgactggcagcaggtccccttctgcagccaccacttccaccagctgatcatgaaggacggccgggagatcgtggtcccctgccgcaaccaggacgagctcgtgggccgggcccgcgtgtcccagggggcgggctggagcctgcgggagaccgcctgcctggggaagtcctacgcccagatgtggcagctcatgtacttccaccgccgggacctgcgcctggccgcgaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatggaggacaagacccacatcagctcctggggcgacgtgccctacctggggaagcgggaggaccagtggtgcggcagcctgatcggcctcacggcccgcgcgacctgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8834 - RNA, 9879 nt, synthetic construct
  misc_feature 1..9879: note = derived and/or modified CDS sequence (opt1) from DENV-1__JQ045659__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtggagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggaggtggccgagacccagcacggcaccgtgctggtccagatcaagtacgagggcaccgacgcgccctgcaagatccccttcagcacgcaggacgagaagggggccacccagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtgttcaccagcgtggggaagctggtccaccagatcttcggcaccgcctacggggtcctcttctccggcgtgagctggacgatgaagatcgggatcggcgtcctgctgacctggctcggcctgaactcccgcagcacctccctgagcatgacctgcatcgccgtggggctcgtgacgctgtacctgggcgtcatggtgcaggccgactccgggtgcgtgatcaactggaagggccgggagctcaagtgcgggagcggcatcttcgtcaccaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcacggtcgtggtgggggacgtcaccggcatcctcgcgcaggggaagaagatgatccggccccagcccatggagtacaagtacagctggaagtcctggggcaaggccaagatcatcggcgccgacgtgcagaacaccaccttcatcatcgacgggcccaacacgccggagtgccccgacgaccagcgcgcctggaacatctgggaggtggaggactacggcttcgggatcttcaccaccaacatctggctgaagctgcgggacagccacacccaggtctgcgaccaccgcctcatgtccgcggccatcaaggacagcaaggccgtgcacgccgacatgggctactggatcgagtccgagaagaacgagacgtggaagctggcccgggcgagcttcatcgaggtgaagacctgcatctggcccaagtcccacaccctgtggagcaacggcgtcctcgagtccgagatgatcatccccaagatctacgggggcccgatcagccagcacaactaccgccccgggtacttcacccagacggccggcccctggcacctggggaagctggagctcgacttcgacctgtgcgagggcaccaccgtggccgtggacgagcactgcggcaaccgggggccgtccctgcgcaccacgaccgtcaccggcaagatcatccacgagtggtgctgccggagctgcaccctgccgcccctccgcttccgcggggaggacggctgctggtacgggatggagatccgccccgtgaaggagaaggaggagaacctggtgaagtccatggtcagcgccggcagcggcgaggtggactccttcagcctcgggctgctgtgcatctccatcatgatcgaggaggtgatgcggagccgctggtcccggaagatgctcatgacgggcaccctggccgtcttcttcctgctcatcatggggcagctgacctggaacgacctgatccgcctctgcatcatggtgggcgcgaacgccagcgaccgcatggggatgggcaccacgtacctggccctgatggccaccttcaagatgcggccgatgttcgccgtggggctcctgttccgccggctgacctcccgcgaggtcctcctgctgaccatcgggctcagcctggtggcgtccatggagctgcccaacagcctcgaggagctgggcgacgggctggccatgggcatcatgatcctcaagctgctgacggacttccagtcccaccagctctgggccaccctgctgagcctcaccttcatcaagaccacgttctccctgcactacgcctggaagaccatggcgatggtgctgagcatcgtctccctcttccccctgtgcctgagcaccacctcccagaagacgacctggctccccgtgctgctgggcagcctcgggtgcaagccgctgaccatgttcctgatcgccgagaacaagatctggggccggcgctcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggagaaggaggccgagcactccggcgcgagccacaacatcctggtggaggtccaggacgacgggaccatgaagatcaaggacgaggagcgggacgacaccctgacgatcctcctgaaggccaccctgctcgccgtgtccggcgtgtacccgctgagcatccccgccaccctgttcgtctggtacttctggcagaagaagaagcagcgctccggggtgctctgggacacccccagcccgcccgaggtgggccgggccgtcctggacgacggcatctaccgcatcatgcagcgggggctgctgggccgctcccaggtgggggtgggcgtcttccaggagaacgtgttccacacgatgtggcacgtgacccgcggggccgtcctcatgtaccagggcaagcggctggagcccagctgggcctccgtgaagaaggacctgatcagctacggcgggggctggcggctccaggggtcctggaacaccggcgaggaggtgcaggtcatcgccgtggagcccgggaagaaccccaagaacgtgcagaccgcccccggcacgttcaagacccccgagggcgaggtcggggccatcgcgctggacttcaagcccggcaccagcgggtcccccatcgtgaaccgcgagggcaagatcgtgggcctgtacgggaacggcgtcgtgaccacgagcgggacctacgtgagcgccatcgcccaggccaaggcgtcccaggagggcccgctccccgagatcgaggacgaggtcttccggaagcgcaacctgaccatcatggacctgcaccccgggagcggcaagacccggcgctacctcccggccatcgtgcgggaggccatcaagcgcaagctgcgcacgctgatcctcgcccccacccgggtggtcgcctccgagatggcggaggccctgaagggcatgcccatccgctaccagaccaccgccgtcaagagcgagcacacggggaaggagatcgtggacctgatgtgccacgccaccttcaccatgcggctcctgtcccccgtccgcgtgccgaactacaacatgatcatcatggacgaggcccacttcaccgaccccagctccatcgcggcccggggctacatcagcacgcgcgtggggatgggcgaggccgccgccatcttcatgaccgcgacgccgcccgggtccgtcgaggccttcccgcagagcaacgccgtgatccaggacgaggagcgggacatccccgagcgctcctggaacagcggctacgagtggatcaccgacttccccggcaagacggtgtggttcgtcccctccatcaagagcgggaacgacatcgccaactgcctgcggaagaacggcaagcgcgtgatccagctctcccggaagaccttcgacaccgagtaccagaagaccaagaacaacgactgggactacgtggtcacgaccgacatcagcgagatgggggcgaacttccgcgccgaccgggtgatcgacccgcgccggtgcctgaagcccgtgatcctgaaggacggccccgagcgcgtcatcctcgccgggcccatgccggtgaccgtggcctccgccgcgcagcggcgcggccggatcggccgcaaccacaacaaggagggggaccagtacatctacatgggccagcccctgaacaacgacgaggaccacgcccactggaccgaggccaagatgctgctcgacaacatcaacacgcccgaggggatcatccccgccctgttcgagccggagcgcgagaagtccgccgcgatcgacggcgagtaccggctgcgcggggaggcccggaagaccttcgtcgagctcatgcgccggggcgacctgcccgtgtggctgtcctacaaggtcgccagcgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcccgcacctactccgaccccctcgccctgcgggagttcaaggagttcgcggccgggcgccggagcgtctccggcgacctgatcctcgagatcggcaagctgccgcagcacctgacgcagcgcgcccagaacgccctcgacaacctggtgatgctgcacaacagcgagcagggcgggcgggcgtaccgccacgccatggaggagctccccgacaccatcgagaccctgatgctgctcgccctgatcgccgtgctgaccgggggcgtcaccctcttcttcctgtccgggcggggcctgggcaagacgagcatcgggctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcggcctcctgttcatgatcctgaccgtggccgcgaacgagatggggctcctggagaccacgaagaaggacctgggcatcgggcacgtggccgtcgagaaccaccaccacgccgccatgctcgacgtggacctgcaccccgcctccgcgtggaccctgtacgccgtggccaccaccatcatcacgccgatgatgcgccacaccatcgagaacaccaccgccaacatcagcctcacggccatcgcgaaccaggccgccatcctgatgggcctggacaagggctggcccatctccaagatggacatcggggtccccctcctggccctgggctgctacagccaggtgaaccccctcaccctgaccgcggccgtgctgatgctcgtcgcccactacgccatcatcgggccgggcctgcaggccaaggcgacccgcgaggcccagaagcggacggccgccgggatcatgaagaaccccaccgtggacggcatcgtggccatcgacctggaccccgtcgtgtacgacgcgaagttcgagaagcagctcggccagatcatgctgctgatcctctgcacctcccagatcctgctgatgcgcaccacgtgggccctctgcgagagcatcaccctggccaccgggcccctgaccacgctctgggagggctccccggggaagttctggaacaccaccatcgccgtgagcatggccaacatcttccggggctcctacctggcgggcgccgggctggccttcagcctcatgaagtccctgggcgggggccgccgggggaccggcgcccagggcgagacgctgggggagaagtggaagcgccagctcaaccagctgtccaagagcgagttcaacacctacaagcggtccggcatcatggaggtcgaccgcagcgaggcgaaggaggggctgaagcggggcgagaccaccaagcacgccgtgtcccgcgggacggccaagctccggtggttcgtggagcgcaacctggtcaagcccgagggcaaggtgatcgacctgggctgcgggcggggcgggtggagctactactgcgccggcctgaagaaggtgaccgaggtcaaggggtacaccaagggcggccccgggcacgaggagcccatcccgatggccacctacggctggaacctcgtgaagctgcactccgggaaggacgtgttcttcatcccgcccgagaagtgcgacacgctgctctgcgacatcggcgagagctcccccaacccgaccatcgaggaggggcgcaccctgcgggtcctgaagatggtggagccctggctccgcggcaaccagttctgcatcaagatcctgaacccctacatgcccagcgtggtcgagaccctggagcagatgcagcggaagcacggcgggatgctcgtgcgcaacccgctgtcccggaacagcacccacgagatgtactgggtgtcctgcggcacggggaacatcgtcagcgcggtgaacatgacctcccgcatgctgctcaaccgcttcaccatggcccaccggaagcccacctacgagcgcgacgtggacctgggcgccggcacgcggcacgtcgccgtggagcccgaggtggccaacctggacatcatcgggcagcgcatcgagaacatcaagcacgagcacaagagcacctggcactacgacgaggacaacccctacaagacctgggcgtaccacggctcctacgaggtcaagccgagcgggtccgccagcagcatggtgaacggcgtggtcaagctcctgaccaagccctgggacgtgatccccatggtcacgcagatcgccatgaccgacaccacccccttcgggcagcagcgggtgttcaaggagaaggtggacacgcgcaccccgaaggccaagcggggcaccgcccagatcatggaggtcaccgcgaagtggctgtggggcttcctctcccgcaacaagcggccccgcatctgcacgcgggaggagttcacccgcaaggtgcggagcaacgccgccatcggggccgtgttcgtcgacgagaaccagtggaactccgcgaaggaggccgtggaggacgagcgcttctgggacctggtgcaccgggagcgcgagctgcacaagcagggcaagtgcgcgacctgcgtctacaacatgatggggaagcgggagaagaagctcggcgagttcgggaaggccaagggcagccgcgccatctggtacatgtggctgggcgcgcggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacaccgccgggtgggacacgcgcatcaccgaggacgacctgcagaacgaggcccgcatcaccgacatcatggagccggagcacgcgctcctggccaagtccatcttcaagctgacctaccagaacaaggtggtccgggtgcagcgccccgccaagaacggcacggtgatggacgtcatcagccggcgcgaccagcgggggtccggccaggtgggcacctacgggctcaacaccttcaccaacatggaggcccagctgatccgccagatggagagcgagggcatcttctcccccagcgagctggagacgcccaacctcgccgagcgggtgctggactggctggagaagtacggggtcgagcgcctcaagcggatggcgatctccggcgacgactgcgtggtgaagccgatcgacgaccgcttcgccaccgccctgaccgccctgaacgacatggggaaggtccggaaggacatcccccagtgggagcccagcaagggctggaacgactggcagcaggtccccttctgctcccaccacttccaccagctcatcatgaaggacggccgcgagatcgtggtcccgtgccggaaccaggacgagctggtggggcgcgcccgggtgagccagggcgcggggtggagcctgcgcgagaccgcctgcctcggcaagtcctacgcccagatgtggcagctgatgtacttccaccggcgcgacctgcggctcgccgcgaacgccatctgcagcgccgtccccgtggactggatccccacgtcccgcaccacctggagcatccacgcccaccaccagtggatgaccacggaggacatgctgtccgtgtggaaccgcgtctggatcgaggagaacccctggatggaggacaagacccacatcagctcctggggcgacgtgccgtacctgggcaagcgggaggaccagtggtgcggcagcctcatcgggctgaccgcccgcgcgacctgggccaccaacatccaggtggccatcaaccaggtccggcgcctgatcggcaacgagaactacctcgactacatgacgtccatgaagcggttcaagaacgagagcgaccccgagggggccctgtggtga

SEQ ID NO: 8835 - RNA, 9879 nt, synthetic construct
  misc_feature 1..9879: note = derived and/or modified CDS sequence (opt1) from DENV-1__JQ045661__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgcccctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgtcgccggcatcctggcgcaggggaagaagatgatccggccccagcccatggagcacaagtacagctggaagtcctggggcaaggccaagatcatcggcgccgacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcacctggcccaagtcccacaccctctggagcaacggcgtcctggagtccgagatgatcatccccaagatctacgggggcccgatcagccagcacaactaccgccccgggtacttcacccagacggccggcccctggcacctggggaagctcgagctggacttcgacctgtgcgagggcaccaccgtggtggtcgacgagcactgcggcaaccgggggccgtccctccgcaccacgaccgtgaccggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgacgggcaccctggccgtgttcttcctcctgatcgtggggcagctgacctggaacgacctcatccgcctgtgcatcatgatcggcgccaacgcgagcgaccgcatggggatgggcaccacgtacctggccctcatggccaccttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgcgatgggcatcatgatcctgaagctgctcacggacttccagtcccaccagctgtgggccaccctgctcagcctgaccttcatcaagaccacgttctccctgcactacgcctggaagaccatggccatggtgctcagcgtcgtgtccctgttccccctgtgcctcagcaccacctcccagaagacgacctggctgcccgtgctgctcggcagcctggggtgcaagccgctgaccatgttcctcatcgcggagaacaagatctggggccggcgctcctggcccctgaacgaggggatcatggccgtcggcatcgtgagcatcctgctcagctccctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcgccagccacaacatcctggtggaggtccaggacgacgggaccatgaagatcaaggacgaggagcgggacgacaccctcacgatcctgctgaaggcgaccctcctggccgtgtccggcgtgtacccgctgagcatccccgccaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacacgatgtggcacgtgacccggggcgccgtcctgatgtaccaggggaagcgcctggagcccagctgggcgtccgtgaagaaggacctcatcagctacggcggcgggtggcggctgcagggctcctggaacaccggggaggaggtgcaggtcatcgccgtggagcccggcaagaaccccaagaacgtgcagaccgcccccgggacgttcaagacccccgagggcgaggtcggcgccatcgccctggacttcaagcccgggaccagcggctcccccatcgtgaaccgcgaggggaagatcgtgggcctctacggcaacggggtcgtgaccacgagcggcacctacgtgagcgcgatcgcccaggccaaggcctcccaggaggggccgctgcccgagatcgaggacgaggtcttccggaagcgcaacctgaccatcatggacctccaccccggcagcgggaagacccggcgctacctgccggcgatcgtgcgggaggccatcaagcgcaagctgcgcacgctcatcctggcccccacccgggtggtcgcctccgagatggccgaggcgctgaagggcatgcccatccgctaccagaccaccgccgtcaagagcgagcacacgggcaaggagatcgtggacctcatgtgccacgccaccttcaccatgcggctgctgtcccccgtccgcgtgccgaactacaacatgatcatcatggacgaggcccacttcaccgaccccagctccatcgccgcgcgggggtacatcagcacgcgcgtgggcatgggggaggccgccgccatcttcatgaccgccacgccgcccggctccgtcgaggcgttcccgcagagcaacgccgtgatccaggacgaggagcgggacatccccgagcgctcctggaacagcgggtacgagtggatcaccgacttccccggcaagacggtgtggttcgtcccctccatcaagagcggcaacgacatcgccaactgcctccggaagaacgggaagcgcgtgatccagctgtcccggaagaccttcgacaccgagtaccagaagaccaagaacaacgactgggactacgtggtcacgaccgacatcagcgagatgggcgccaacttccgcgcggaccgggtgatcgacccgcgccggtgcctgaagcccgtgatcctcaaggacgggcccgagcgcgtcatcctggccggccccatgccggtgaccgtcgcctccgccgcccagcggcgcgggcggatcggccgcaaccacaacaaggagggcgaccagtacatctacatggggcagcccctgaacaacgacgaggaccacgcgcactggaccgaggccaagatgctcctggacaacatcaacacgcccgagggcatcatccccgccctgttcgagccggagcgcgagaagtccgccgccatcgacggggagtaccggctccgcggcgaggcgcggaagaccttcgtggagctgatgcgccgcggggacctgcccgtgtggctctcctacaaggtcgccagcgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcccgcacctactccgaccccctggccctgcgggagttcaaggagttcgccgcgggccgccggagcgtctccggggacctcatcctggagatcggcaagctgccgcagcacctcacgcagcgcgcccagaacgccctggacaacctggtgatgctccacaacagcgagcagggcgggcgggcctaccgccacgcgatggaggagctgcccgacaccatcgagaccctgatgctcctggccctgatcgccgtgctcaccggcggggtcaccctgttcttcctgtccggccgggggctcggcaagacgagcatcggcctgctgtgcgtgatggcctccagcgtgctcctgtggatggcctccgtcgagccccactggatcgcggccagcatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccacgaagaaggacctcgggatcggccacgtggcggtcgagaaccaccaccacgccgccatgctggacgtggacctgcaccccgcctccgcctggaccctctacgcggtggccaccaccatcatcacgccgatgatgcgccacaccatcgagaacaccaccgccaacatcagcctgacggccatcgccaaccaggcggccatcctgatggggctcgacaagggctggcccatctccaagatggacatcggcgtccccctgctggccctcgggtgctacagccaggtgaaccccctgaccctgaccgccgcggtgctcatgctggtcgcccactacgccatcatcggcccggggctgcaggccaaggccacccgcgaggcgcagaagcggacggccgccggcatcatgaagaaccccaccgtggacgggatcgtggccatcgacctcgaccccgtcgtgtacgacgccaagttcgagaagcagctgggccagatcatgctgctcatcctgtgcacctcccagatcctgctcatgcgcaccacgtgggcgctgtgcgagagcatcaccctggccaccggccccctcaccacgctgtgggaggggtccccgggcaagttctggaacaccaccatcgccgtgagcatggccaacatcttccgggggtcctacctggccggcgcgggcctcgccttcagcctgatgaagtccctcgggggcgggcgccgggggaccggggcccagggcgagacgctcggcgagaagtggaagcgccagctgaaccagctgtccaagagcgagttcaacacctacaagcggtccgggatcatggaggtcgaccgcagcgaggccaaggagggcctcaagcgcggggagaccaccaagtacgcggtgtcccgcggcacggccaagctgcggtggttcgtggagcgcaacctggtcaagcccgaggggaaggtgatcgacctgggctgcggccgcgggggctggagctactactgcgccgggctcaagaaggtgaccgaggtcaagggctacaccaagggcggccccggccacgaggagcccatcccgatggccacctacgggtggaacctggtgaagctgcactccggcaaggacgtgttcttcatcccgcccgagaagtgcgacacgctcctgtgcgacatcggggagagctcccccaacccgaccatcgaggagggccgcaccctgcgggtcctcaagatggtggagccctggctgcgcgggaaccagttctgcatcaagatcctgaacccctacatgcccagcgtggtcgagaccctcgagcagatgcagcggaagcacggcggcatgctggtgcgcaacccgctgtcccggaacagcacccacgagatgtactgggtgtcctgcgggacgggcaacatcgtcagcgccgtgaacatgacctcccgcatgctcctgaaccgcttcaccatggcgcaccggaagcccacctacgagcgcgacgtggacctgggggccggcacgcggcacgtcgccgtggagcccgaggtggccaacctcgacatcatcggccagcgcatcgagaacatcaagcacgagcacaagagcacctggcactacgacgaggacaacccctacaagacctgggcctaccacgggtcctacgaggtcaagccgagcggctccgcgagcagcatggtgaacggggtcgtgaagctgctgaccaagccctgggacgtgatccccatggtcacgcagatcgccatgaccgacaccacccccttcggccagcagcgggtgttcaaggagaaggtggacacgcgcaccccgaaggccaagcgggggaccgcccagatcatggaggtcaccgccaagtggctctggggcttcctgtcccgcaacaagaagccccggatctgcacgcgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacgcggatcaccgaggacgacctccagaacgaggcccgcatcaccgacatcatggagccggagcacgccctgctggcgaagtccatcttcaagctcacctaccagaacaaggtggtccgcgtgcagcggcccgccaagaacgggacggtgatggacgtcatcagccgccgggaccagcgcggctccggccaggtggggacctacggcctgaacaccttcaccaacatggaggcccagctgatccggcagatggagagcgaggggatcttctcccccagcgagctcgagacgcccaacctggccgagcgcgtgctggactggctcgagaagtacggcgtcgagcggctgaagcgcatggccatctccggggacgactgcgtggtgaagccgatcgacgaccggttcgcgaccgccctgaccgccctcaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctggtgggccgggcccgcgtgagccagggggccggctggagcctccgggagaccgcgtgcctggggaagtcctacgcccagatgtggcagctgatgtacttccaccgccgggacctccgcctggccgccaacgcgatctgcagcgccgtccccgtggactggatccccacgtcccggaccacctggagcatccacgcccaccaccagtggatgaccacggaggacatgctgtccgtgtggaaccgcgtctggatcgaggagaacccctggatggaggacaagacccacatcagctcctggggcgacgtgccgtacctcgggaagcgcgaggaccagtggtgcggcagcctgatcggcctgaccgcccgggccacctgggcgaccaacatccaggtggccatcaaccaggtccgccggctcatcgggaacgagaactacctggactacatgacgtccatgaagcgcttcaagaacgagagcgaccccgagggcgccctgtggtga

SEQ ID NO: 8836 - RNA, 9879 nt, synthetic construct
  misc_feature 1..9879: note = derived and/or modified CDS sequence (opt1) from DENV-1__JQ045663__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccacggacacctgggtcacctacgggacctgcagccagacgggcgagcaccggcgggacaagcggtccgtggccctcgcgccccacgtgggcctggggctggagacccgcaccgagacctggatgagctccgagggcgcctggaagcagatccagcgggtcgagacgtgggccctccggcaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccgtgctgcggaagctctgcatcgaggcgaagatctccaacaccacgaccgacagccgctgcccgacccagggcgaggccaccctggtggaggagcaggacgccaacttcgtctgccggcgcacgttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacacgggcgaccagcaccaggtggggaacgagtccaccgagcacggcaccaccgccaccatcacgccccaggcgcccaccaccgagatccagctcaccgactacggggccctgacgctggactgcagcccccgcaccggcctcgacttcaacgagatggtcctgctgaccatgaaggagaagtcctggctcgtgcacaagcagtggttcctggacctgccgctcccctggaccagcggggccagcacgtcccaggagacctggaaccggcaggacctgctggtgaccttcaagaccgcccacgccaagaagcaggaggtcgtggtgctcggcagccaggagggcgcgatgcacacggccctgaccggggccaccgagatccagacctccggcacgaccaccatcttcgccgggcacctgaagtgccgcctcaagatggacaagctgaccctgaagggcatgagctacgtcatgtgcacggggtccttcaagctcgagaaggagctggccgagacccagcacggcaccgtgctggtgcagatcaagtacgagggcaccgacgcgccctgcaagatccccttcagcacgcaggacgagaagggggtcacccagaacggccggctgatcaccgccaacccgatcgtgaccgacaaggagaagcccgtgaacatcgaggccgagccgcccttcggggagtcctacatcgtcatcggcgccggcgagaaggcgctcaagctgagctggttcaagaaggggtccagcatcggcaagatgttcgaggccacggcccgcggggcccggcgcatggccatcctgggcgacaccgcgtgggacttcgggtccatcggcggcgtgttcaccagcgtggggaagctcgtccaccagatcttcggcaccgcctacggggtgctgttctccggcgtgagctggacgatgaagatcgggatcggcgtcctgctcacctggctgggcctgaactcccgcagcacctccctcagcatgacctgcatcgccgtggggctggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagctgacggtcgtggtgggggacgtcgccggcatcctggcgcaggggaagaagatgatccggccccagcccatggagtacaagtacagctggaagtcctggggcaaggccaagatcatcggcgccgacgtgcagaacaccaccttcatcatcgacgggcccagcaccccggagtgccccgacgaccagcgcgcctggaacatctgggaggtggaggactacggcttcgggatcttcacgaccaacatctggctcaagctgcgggactcccacacccaggtctgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcatctggcccaagagccacaccctgtggtccaacggcgtcctggagagcgagatgatcatccccaagatctacgggggcccgatctcccagcacaactaccgccccgggtacttcacccagaccgccggcccctggcacctcgggaagctggagctggacttcgacctctgcgagggcacgaccgtggtggtcgacgagcactgcggcaaccgggggccgagcctgcgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctggtcaagagcatggtgagcgccggctccggcgaggtggacagcttctccctggggctcctgtgcatcagcatcatgatcgaggaggtcatgcggtcccgctggagccggaagatgctgatgaccggcacgctcgccgtgttcttcctgctgatcatggggcagctcacctggaacgacctgatccgcctgtgcatcatggtgggcgccaacgcgtccgaccgcatggggatgggcaccacctacctcgccctgatggccacgttcaagatgcggccgatgttcgccgtcggcctcctgttccgccggctgaccagccgcgaggtgctgctcctgaccatcgggctgtccctcgtggccagcgtcgagctgcccaactccctggaggagctcggcgacgggctggcgatgggcatcatgatcctgaagctcctgaccgacttccagagccaccagctgtgggccacgctcctgtccctgaccttcatcaagaccaccttcagcctccactacgcctggaagacgatggccatggtgctgtccatcgtcagcctgttccccctctgcctgtccaccaccagccagaagaccacgtggctgcccgtgctcctgggctccctggggtgcaagccgctcaccatgttcctgatcgcggagaacaagatctggggccggcgcagctggcccctgaacgaggggatcatggccgtgggcatcgtcagcatcctcctgtccagcctgctcaagaacgacgtgcccctggccgggcccctgatcgccggcggcatgctcatcgcctgctacgtgatctccgggagctccgcggacctgagcctggagaaggccgccgaggtctcctgggaggaggaggccgagcacagcggcgcctcccacaacatcctcgtggaggtgcaggacgacgggaccatgaagatcaaggacgaggagcgggacgacaccctgaccatcctgctcaaggcgacgctgctggccgtcagcggcgtgtacccgctctccatccccgccaccctgttcgtgtggtacttctggcagaagaagaagcagcgcagcggggtcctgtgggacacccccagcccgcccgaggtggagcgggccgtgctggacgacggcatctaccgcatcatgcagcggggcctcctggggcgcagccaggtcggcgtgggggtgttccaggagaacgtcttccacaccatgtggcacgtgacgcggggcgccgtgctgatgtaccaggggaagcgcctcgagccctcctgggcgagcgtcaagaaggacctgatctcctacggcggcgggtggcggctgcagggcagctggaacaccggggaggaggtccaggtgatcgccgtcgagcccggcaagaactccaagaacgtgcagaccgcccccgggaccttcaagacgcccgagggcgaggtgggcgccatcgccctcgacttcaagcccgggaccagcggcagccccatcgtcaaccgcgaggggaagatcgtgggcctgtacggcaacggggtggtcaccacctccggcacgtacgtgagcgcgatcgcccaggccaaggcctcccaggaggggcccctgccggagatcgaggacgaggtgttccggaagcgcaacctcaccatcatggacctgcaccccggcagcgggaagacccggcgctacctgcccgcgatcgtccgggaggccatcaagcgcaagctccgcaccctgatcctggccccgacgcgggtggtggcctccgagatggccgaggcgctcaagggcatgcccatccgctaccagaccaccgccgtcaagagcgagcacaccggcaaggagatcgtggacctgatgtgccacgccacgttcaccatgcggctgctctcccccgtgcgcgtccccaactacaacatgatcatcatggacgaggcccacttcaccgacccgagctccatcgccgcgcgggggtacatcagcacccgcgtgggcatgggggaggccgccgccatcttcatgacggccacgccgcccggctccgtggaggcgttcccccagagcaacgccgtcatccaggacgaggagcgggacatcccggagcgctcctggaacagcgggtacgagtggatcaccgacttccccggcaagaccgtgtggttcgtgccctccatcaagagcggcaacgacatcgccaactgcctgcggaagaacgggaagcgcgtcatccagctgtcccggaagacgttcgacaccgagtaccagaagaccaagaacaacgactgggactacgtggtgaccacggacatcagcgagatgggcgccaacttccgcgcggaccgggtcatcgacccccgccggtgcctcaagccggtgatcctgaaggacgggcccgagcgcgtgatcctggccggccccatgcccgtcaccgtggcctccgccgcccagcggcgcgggcggatcggccgcaaccacaacaaggagggcgaccagtacatctacatggggcagccgctcaacaacgacgaggaccacgcgcactggaccgaggccaagatgctgctggacaacatcaacacccccgagggcatcatccccgccctcttcgagcccgagcgcgagaagtccgccgccatcgacggggagtaccggctgcgcggcgaggcgcggaagacgttcgtcgagctgatgcgccgcggggacctcccggtgtggctgagctacaaggtggcctccgagggcttccagtacagcgaccgccggtggtgcttcgacggcgagcgcaacaaccaggtcctggaggagaacatggacgtggagatctggaccaaggagggggagcggaagaagctccgcccccggtggctggacgcccgcacctactccgaccccctggccctccgggagttcaaggagttcgccgcgggccgccggagcgtgtccggggacctgatcctggagatcggcaagctcccccagcacctgacccagcgcgcccagaacgccctggacaacctcgtcatgctgcacaacagcgagcagggcgggcgggcctaccgccacgcgatggaggagctgccggacacgatcgagaccctcatgctgctggccctcatcgccgtgctgaccggcggggtgaccctgttcctcctgtccggccgggggctgggcaagaccagcatcggcctcctgtgcgtcatggcctccagcgtgctgctctggatggcctccgtggagccccactggatcgcggccagcatcatcctggagttcttcctgatggtcctcctgatccccgagcccgaccgccagcggacgccgcaggacaaccagctggcctacgtggtgatcgggctcctgttcatgatcctgaccgtcgccgccaacgagatgggcctcctggagaccaccaagaaggacctggggatcggccacgtggcggtggagaaccaccaccacgccgccatgctcgacgtcgacctgcaccccgcctccgcctggacgctgtacgcggtggccaccaccatcatcacccccatgatgcgccacacgatcgagaacaccaccgccaacatcagcctcaccgccatcgccaaccaggcggccatcctgatggggctggacaagggctggccgatctccaagatggacatcggcgtgcccctcctggccctggggtgctacagccaggtcaaccccctcacgctgaccgccgcggtgctgatgctcgtggcccactacgccatcatcggccccgggctgcaggccaaggccacccgcgaggcgcagaagcggaccgccgccggcatcatgaagaacccgacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccggccccctgaccaccctctgggaggggtcccccggcaagttctggaacacgaccatcgccgtgagcatggccaacatcttccgggggagctacctggccggcgcgggcctggccttctccctcatgaagtccctcgggggcgggcgccgggggaccggggcccagggcgagaccctgggcgagaagtggaagcgccagctcaaccagctgtccaagagcgagttcaacacgtacaagcggtccgggatcatggaggtggaccgcagcgaggccaaggagggcctgaagcgcggggagaccaccaagcacgcggtctcccgcggcaccgccaagctgcggtggttcgtggagcgcaacctcgtgaagccggaggggaaggtcatcgacctgggctgcggccgcgggggctggagctactactgcgccgggctgaagaaggtgacggaggtgaagggctacaccaagggcggccccggccacgaggagcccatccccatggccacctacgggtggaacctcgtcaagctgcactccggcaaggacgtgttcttcatcccgcccgagaagtgcgacaccctgctctgcgacatcggggagagctcccccaaccccacgatcgaggagggccgcaccctgcgggtgctgaagatggtcgagccgtggctccgcgggaaccagttctgcatcaagatcctgaacccctacatgcccagcgtggtggagaccctggagcagatgcagcggaagcacggcggcatgctcgtccgcaaccccctgtcccggaacagcacccacgagatgtactgggtgtcctgcgggaccggcaacatcgtgagcgccgtcaacatgacgtcccgcatgctgctcaaccgcttcaccatggcgcaccggaagccgacctacgagcgcgacgtggacctgggggccggcacccggcacgtggccgtcgagcccgaggtggccaacctggacatcatcggccagcgcatcgagaacatcaagcacgagcacaagagcacgtggcactacgacgaggacaacccctacaagacctgggcctaccacgggtcctacgaggtgaagcccagcggcagcgcgtccagcatggtcaacggggtggtcaagctcctgaccaagccgtgggacgtgatccccatggtgacccagatcgccatgacggacaccacccccttcggccagcagcgggtcttcaaggagaaggtggacacccgcacgcccaaggccaagcgggggaccgcccagatcatggaggtgaccgccaagtggctgtggggcttcctctcccgcaacaagaagccgcggatctgcacccgcgaggagttcacgcggaaggtccgcagcaacgcggccatcggcgccgtgttcgtggacgagaaccagtggaactccgccaaggaggcggtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaaggggagccgggccatctggtacatgtggctgggcgcccgcttcctggagttcgaggcgctcggcttcatgaacgaggaccactggttctcccgggagaacagcctgtccggggtcgagggcgaggggctgcacaagctcggctacatcctgcgcgacatcagcaagatccccgggggcaacatgtacgccgacgacaccgccggctgggacacccggatcacggaggacgacctgcagaacgaggcccgcatcaccgacatcatggagcccgagcacgccctcctggcgaagtccatcttcaagctgacctaccagaacaaggtggtgcgcgtccagcggccggccaagaacgggaccgtgatggacgtgatcagccgccgggaccagcgcggctccgggcaggtcggcacgtacggcctcaacaccttcaccaacatggaggcccagctgatccggcagatggagagcgaggggatcttctcccccagcgagctggagacccccaacctcgccgagcgcgtgctggactggctggagaagtacggcgtggagcggctcaagcgcatggccatctccggggacgactgcgtcgtgaagcccatcgacgaccggttcgcgacggccctgaccgccctgaacgacatgggcaaggtgcgcaaggacatcccgcagtgggagcccagcaaggggtggaacgactggcagcaggtccccttctgcagccaccacttccaccagctcatcatgaaggacggccgggagatcgtggtgccctgccgcaaccaggacgagctggtcggccgggcccgcgtgtcccagggggccggctggagcctgcgggagaccgcgtgcctcgggaagtcctacgcccagatgtggcagctgatgtacttccaccgccgggacctgcgcctcgccgccaacgcgatctgcagcgccgtgccggtcgactggatccccacctcccggacgacctggagcatccacgcccaccaccagtggatgaccaccgaggacatgctgtccgtgtggaaccgcgtgtggatcgaggagaacccctggatggaggacaagacgcacatcagctcctggggcgacgtcccctacctggggaagcgcgaggaccagtggtgcggcagcctcatcggcctgaccgcccgggccacctgggcgaccaacatccaggtggccatcaaccaggtgcgccggctgatcgggaacgagaactacctcgactacatgacctccatgaagcgcttcaagaacgagagcgacccggagggcgccctgtggtga

SEQ ID NO: 8837 - RNA, 9879 nt, synthetic construct
  misc_feature 1..9879: note = derived and/or modified CDS sequence (opt1) from DENV-1__JQ045665__SS-prME
  source 1..9879: mol_type = other RNA
agcgtgaccatgctgctcatgctgatgcccaccgccctggccttccacctcaccgcccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacctgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggccacgcagaacggccggctgatcaccgccaacccgatcgtcaccgacaaggagaagcccgtgaacatcgaggcggagccgcccttcggggagtcctacatcgtgatcggcgccggcgagaaggccctcaagctgagctggttcaagaaggggtccagcatcggcaagatgttcgaggccaccgcccgcggggcgcggcgcatggccatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggcggactccgggtgcgtgatcaactggaagggccgggagctgaagtgcgggagcggcatcttcgtgacgaacgaggtccacacctggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtggtcgtgggggacgtggccggcatcctggcccaggggaagaagatgatccggccccagcccatggagtacaagtacagctggaagtcctggggcaaggccaagatcatcggcgcggacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtgaacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgcctgtcccggaagatgctgatgaccggcaccctcgcggtcttcttcctgctgatcatggggcagctcacgtggaacgacctgatccgcctgtgcatcatggtgggcgccaacgccagcgaccgcatggggatgggcaccacctacctcgccctgatggccaccttcaagatgcggccgatgttcgcggtgggcctcctgttccgccggctgacgtcccgcgaggtcctgctcctgaccatcgggctgagcctcgtggcctccgtggagctgcccaacagcctggaggagctcggcgacgggctggccatgggcatcatgatcctgaagctcctgaccgacttccagtcccaccagctgtgggccaccctcctgagcctgacgttcatcaagaccaccttctccctccaccacgcgtggaagaccatggccatgatcctgagcatcgtctccctgttccccctctgcctgagcacgacctcccagaagaccacctggctgcccgtgctcctgggcagcctggggtgcaagccgctcacgatgttcctgatcgccgagaacaagatctggggccggcgctcctggcccctgaacgaggggatcatggccgtcggcatcgtgagcatcctcctgagctccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggaccatgaagatcaaggacgaggagcgggacgacaccctgaccatcctgctcaaggccaccctgctggccgtgtccggcgtgtacccgctcagcatccccgccacgctgttcgtctggtacttctggcagaagaagaagcagcgctccggggtgctgtgggacacccccagcccgcccgaggtggagcgggcggtcctggacgacggcatctaccgcatcatgcagcggggcctcctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgcgatcgccctcgacttcaagcccgggacgagcggctcccccatcgtgaaccgcgaggggaagatcgtgggcctgtacggcaacggggtcgtgaccaccagcggcacctacgtgagcgccatcgcccaggcgaaggcctcccaggaggggccgctgcccgagatcgaggacgaggtcttccggaagcgcaacctcacgatcatggacctgcaccccggcagcgggaagacccggcgctacctgccggccatcgtgcgggaggccatcaagcgcaagctccgcaccctgatcctggcccccacccgggtggtcgcgtccgagatggccgaggccctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcgcacttcaccgaccccagctccatcgccgcccgggggtacatcagcacccgcgtgggcatgggggaggccgccgcgatcttcatgaccgccacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgcgaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgccgaccgggtgatcgacccgcgccggtgcctcaagcccgtgatcctgaaggacgggcccgagcgcgtcatcctggccggccccatgccggtgacggtggcctccgcggcccagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgcggccatcgacggggagtaccggctgcgcggcgaggcccggaagtccttcgtcgagctgatgcgccgcggggacctccccgtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccgcagcacctgacccagcgcgcccagaacgcgctggacaacctcgtgatgctgcacaactccgagcagggcgggcgggcctaccgccacgccatggaggagctgcccgacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagccggaccgccagcggacgccccaggacaaccagctggcctacgtggtcatcgggctcctgttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcaccccgatgatgcgccacaccatcgagaacaccacggccaacatctccctgaccgcgatcgccaaccaggccgccatcctcatggggctggacaagggctggcccatcagcaagatggacatcggcgtccccctgctcgcgctggggtgctactcccaggtgaaccccctgaccctcaccgccgccgtgctgatgctggtcgcccactacgccatcatcggcccggggctccaggcgaaggccacgcgcgaggcccagaagcggaccgccgccggcatcatgaagaaccccaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagcccgggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctggtcaagcccgaggggaaggtgatcgacctcggctgcggccgcggcgggtggtcctactactgcgccgggctgaagaaggtgaccgaggtcaaggggtacaccaagggcgggcccggccacgaggagcccatcccgatggcgacgtacgggtggaacctggtgaagctccacagcggcaaggacgtgttcttcatcccgcccgagaagtgcgacaccctgctgtgcgacatcggggagtccagccccaacccgaccatcgaggagggccgcaccctccgggtcctgaagatggtggagccctggctgcgcgggaaccagttctgcatcaagatcctcaacccctacatgccctccgtggtcgagacgctggagcagatgcagcggcgccacggcggcatgctggtgcggaacccgctcagccgcaactccacccacgagatgtactgggtgagctgcgggaccggcaacatcgtctccgccgtgaacatgaccagccgcatgctgctgaaccggttcaccatggcccaccgcaagcccacgtacgagcgggacgtggacctcggggccggcacccgccacgtcgccgtggagcccgaggtggcgaacctggacatcatcggccagcggatcgagaacatcaagcacgagcacaagtccacctggcactacgacgaggacaacccctacaagacctgggcctaccacgggagctacgaggtcaagccgtccggcagcgccagctccatggtgaacggggtggtcaagctgctcacgaagccctgggacgtgatccccatggtcacccagatcgccatgaccgacaccacgcccttcggccagcagcgcgtgttcaaggagaaggtggacacccggaccccgaaggccaagcgcgggaccgcgcagatcatggaggtcacggccaagtggctgtggggcttcctgagccggaacaagaagccccgcatctgcacccgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgccgacgacacggccggctgggacacccgcatcaccgaggacgacctgcagaacgaggcgcgcatcaccgacatcatggagccggagcacgccctgctcgccaagagcatcttcaagctgacgtaccagaacaaggtggtccgggtgcagcgccccgccaagaacgggaccgtgatggacgtcatctcccggcgcgaccagcggggcagcggccaggtggggacctacggcctgaacaccttcacgaacatggaggcccagctcatccgccagatggagtccgaggggatcttcagcccctccgagctggagacccccaacctggcggagcgggtgctcgactggctggagaagtacggcgtcgagcgcctgaagcggatggccatcagcggggacgactgcgtggtgaagccgatcgacgaccgcttcgccaccgccctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcgcgggtgagccagggggccggctggtccctgcgcgagacggcctgcctgggcaagagctacgcccagatgtggcagctcatgtacttccaccggcgcgacctgcggctggcggccaacgccatctgctccgccgtccccgtggactggatccccacgacctgcaccacgtggagcatccacgcccaccaccagtggatgaccaccgaggacatgctctccgtgtggaaccgcgtctggatcgaggagaacccctggatggaggacaagacccacatcagctcctggggcgacgtgccgtacctggggaagcgcgaggaccagtggtgcggcagcctgatcggcctcacggcgcgggccacctgggccaccaacatccaggtggccatcaaccaggtccgccggctgatcgggaacgagaactacctggactacatgacctccatgaagcgcttcaagaacgagagcgaccccgagggcgccctctggtga

SEQ ID NO: 8838 - RNA, 9879 nt, synthetic construct
  misc_feature 1..9879: note = derived and/or modified CDS sequence (opt1) from DENV-1__JQ045666__SS-prME
  source 1..9879: mol_type = other RNA
agcgtgaccatgctgctcatgctgatgcccaccgccctggccttccacctcaccgcccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgagaccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccggcaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggagctggcggagacgcagcacggcaccgtgctggtgcagatcaagtacgagggcaccgacgccccctgcaagatccccttcagcacccaggacgagaagggggccacgcagaacggccggctgatcaccgccaacccgatcgtcaccgacaaggagaagcccgtgaacatcgaggcggagccgcccttcggggagtcctacatcgtgatcggcgccggcgagaaggccctcaagctgagctggttcaagaaggggtccagcatcggcaagatgttcgaggccaccgcccgcggggcgcggcgcatggccatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgccgtcgggctggtgaccctgtacctcggcgtgatggtccaggcggactccgggtgcgtgatcaactggaagggccgggagctgaagtgcgggagcggcatcttcgtgacgaacgaggtccacacctggaccgagcagtacaagttccaggccgacagcccgaagcgcctgtccgccgccatcggcaaggcctgggaggagggggtgtgcggcatccggagcgcgacccgcctcgagaacatcatgtggaagcagatctccaacgagctgaaccacatcctgctcgagaacgacatgaagttcaccgtggtcgtgggggacgtggccggcatcctggcccaggggaagaagatgatccggccccagcccatggagtacaagtacagctggaagtcctggggcaaggccaagatcatcggcgcggacgtccagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcatctggcccaagtcccacacgctctggagcaacggcgtgctggagtccgagatgatcatccccaagatctacgggggcccgatcagccagcacaactaccgccccgggtacttcacccagaccgccggcccctggcacctggggaagctcgagctggacttcgacctgtgcgagggcaccacggtcgtggtgaacgagcactgcggcaaccgggggccgtccctccgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctcgtgaagtccatggtcagcgccggcagcggcgaggtggactccttcagcctggggctgctctgcatctccatcatgatcgaggaggtgatgcggagccgcctgtcccggaagatgctgatgaccggcaccctcgcggtcttcttcctgctgatcatggggcagctcacgtggaacgacctgatccgcctgtgcatcatggtgggcgccaacgccagcgaccgcatggggatgggcaccacctacctcgccctgatggccaccttcaagatgcggccgatgttcgcggtgggcctcctgttccgccggctgacgtcccgcgaggtcctgctcctgaccatcgggctgagcctcgtggcctccgtggagctgcccaacagcctggaggagctcggcgacgggctggccatgggcatcatgatcctgaagctcctgaccgacttccagtcccaccagctgtgggccaccctcctgagcctgacgttcatcaagaccaccttctccctccaccacgcgtggaagaccatggccatgatcctgagcatcgtctccctgttccccctctgcctgagcacgacctcccagaagaccacctggctgcccgtgctcctgggcagcctggggtgcaagccgctcacgatgttcctgatcgccgagaacaagatctggggccggcgctcctggcccctgaacgaggggatcatggccgtcggcatcgtgagcatcctcctgagctccctgctcaagaacgacgtgcccctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggaccatgaagatcaaggacgaggagcgggacgacaccctgaccatcctgctcaaggccaccctgctggccgtgtccggcgtgtacccgctcagcatccccgccacgctgttcgtctggtacttctggcagaagaagaagcagcgctccggggtgctgtgggacacccccagcccgcccgaggtggagcgggcggtcctggacgacggcatctaccgcatcatgcagcggggcctcctggggcgctcccaggtgggcgtgggggtcttccaggagaacgtgttccacaccatgtggcacgtgacccggggcgccgtcctgatgtaccaggggaagcgcctcgagcccagctgggcctccgtgaagaaggacctgatcagctacggcggcgggtggcggctgcagggctcctggaacacgggggaggaggtgcaggtcatcgccgtggagcccggcaagaaccccaagaacgtgcagaccgcccccgggaccttcaagacccccgagggcgaggtcggcgcgatcgccctcgacttcaagcccgggacgagcggctcccccatcgtgaaccgcgaggggaagatcgtgggcctgtacggcaacggggtcgtgaccaccagcggcacctacgtgagcgccatcgcccaggcgaaggcctcccaggaggggccgctgcccgagatcgaggacgaggtcttccggaagcgcaacctcacgatcatggacctgcaccccggcagcgggaagacccggcgctacctgccggccatcgtgcgggaggccatcaagcgcaagctccgcaccctgatcctggcccccacccgggtggtcgcgtccgagatggccgaggccctcaagggcatgcccatccgctaccagacgaccgccgtcaagagcgagcacaccggcaaggagatcgtggacctgatgtgccacgccaccttcacgatgcggctgctctcccccgtccgcgtgccgaactacaacatgatcatcatggacgaggcgcacttcaccgaccccagctccatcgccgcccgggggtacatcagcacccgcgtgggcatgggggaggccgccgcgatcttcatgaccgccacgccgcccggctccgtcgaggccttcccgcagagcaacgccgtgatccaggacgaggagcgggacatccccgagcgctcctggaacagcgggtacgagtggatcaccgacttccccggcaagaccgtgtggttcgtcccctccatcaagagcggcaacgacatcgcgaactgcctgcggaagaacgggaagcgcgtgatccagctgtcccggaagaccttcgacacggagtaccagaagaccaagaacaacgactgggactacgtggtcaccaccgacatcagcgagatgggcgccaacttccgcgccgaccgggtgatcgacccgcgccggtgcctcaagcccgtgatcctgaaggacgggcccgagcgcgtcatcctggccggccccatgccggtgacggtggcctccgcggcccagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgcggccatcgacggggagtaccggctgcgcggcgaggcccggaagtccttcgtcgagctgatgcgccgcggggacctccccgtgtggctgagctacaaggtcgccagcgagggcttccagtactccgaccgccggtggtgcttcgacggcgagcgcaacaaccaggtgctggaggagaacatggacgtggagatctggaccaaggagggggagcggaagaagctccgcccccggtggctggacgcccgcacgtacagcgaccccctggcgctccgggagttcaaggagttcgccgccggccgccggtccgtcagcggggacctgatcctggagatcggcaagctcccgcagcacctgacccagcgcgcccagaacgcgctggacaacctcgtgatgctgcacaactccgagcagggcgggcgggcctaccgccacgccatggaggagctgcccgacaccatcgagaccctcatgctgctggccctcatcgccgtgctgacgggcggggtcaccctgttcttcctcagcggccgggggctgggcaagacctccatcggcctgctctgcgtgatggcgagctccgtgctgctgtggatggccagcgtcgagccccactggatcgccgcctccatcatcctcgagttcttcctgatggtgctgctcatccccgagccggaccgccagcggacgccccaggacaaccagctggcctacgtggtcatcgggctcctgttcatgatcctgaccgtggcggccaacgagatgggcctgctcgagacgaccaagaaggacctggggatcggccacgtggccgtcgagaaccaccaccacgccgccatgctggacgtggacctccaccccgcgagcgcctggaccctgtacgccgtggccaccacgatcatcaccccgatgatgcgccacaccatcgagaacaccacggccaacatctccctgaccgcgatcgccaaccaggccgccatcctcatggggctggacaagggctggcccatcagcaagatggacatcggcgtccccctgctcgcgctggggtgctactcccaggtgaaccccctgaccctcaccgccgccgtgctgatgctggtcgcccactacgccatcatcggcccggggctccaggcgaaggccacgcgcgaggcccagaagcggaccgccgccggcatcatgaagaaccccaccgtggacgggatcgtggcgatcgacctggaccccgtcgtgtacgacgccaagttcgagaagcagctgggccagatcatgctcctgatcctgtgcaccagccagatcctcctgatgcgcacgacctgggccctgtgcgagtccatcaccctcgccaccggccccctgacgaccctgtgggaggggagcccgggcaagttctggaacaccaccatcgccgtgtccatggcgaacatcttccgggggagctacctcgccggcgccggcctggccttcagcctgatgaagtccctcgggggcgggcgccggggcacgggggcgcagggcgagaccctgggcgagaagtggaagcgccagctgaaccagctcagcaagtccgagttcaacacctacaagcggagcgggatcatggaggtcgaccgctccgaggccaaggagggcctgaagcgcggggagaccacgaagcacgccgtgagccgcggcaccgccaagctgcggtggttcgtggagcgcaacctggtcaagcccgaggggaaggtgatcgacctcggctgcggccgcggcgggtggtcctactactgcgccgggctgaagaaggtgaccgaggtcaaggggtacaccaagggcgggcccggccacgaggagcccatcccgatggcgacgtacgggtggaacctggtgaagctccacagcggcaaggacgtgttcttcatcccgcccgagaagtgcgacaccctgctgtgcgacatcggggagtccagccccaacccgaccatcgaggagggccgcaccctccgggtcctgaagatggtggagccctggctgcgcgggaaccagttctgcatcaagatcctcaacccctacatgccctccgtggtcgagacgctggagcagatgcagcggcgccacggcggcatgctggtgcggaacccgctcagccgcaactccacccacgagatgtactgggtgagctgcgggaccggcaacatcgtctccgccgtgaacatgaccagccgcatgctgctgaaccggttcaccatggcccaccgcaagcccacgtacgagcgggacgtggacctcggggccggcacccgccacgtcgccgtggagcccgaggtggcgaacctggacatcatcggccagcggatcgagaacatcaagcacgagcacaagtccacctggcactacgacgaggacaacccctacaagacctgggcctaccacgggagctacgaggtcaagccgtccggcagcgccagctccatggtgaacggggtggtcaagctgctcacgaagccctgggacgtgatccccatggtcacccagatcgccatgaccgacaccacgcccttcggccagcagcgcgtgttcaaggagaaggtggacacccggaccccgaaggccaagcgcgggaccgcgcagatcatggaggtcacggccaagtggctgtggggcttcctgagccggaacaagaagccccgcatctgcacccgggaggagttcacccgcaaggtgcggtccaacgccgccatcggcgcggtgttcgtcgacgagaaccagtggaacagcgccaaggaggccgtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggtcccgcgcgatctggtacatgtggctcggcgcccggttcctggagttcgaggccctgggcttcatgaacgaggaccactggttcagccgcgagaactccctcagcggggtggagggcgaggggctgcacaagctgggctacatcctccgggacatctccaagatccccgggggcaacatgtacgccgacgacacggccggctgggacacccgcatcaccgaggacgacctgcagaacgaggcgcgcatcaccgacatcatggagccggagcacgccctgctcgccaagagcatcttcaagctgacgtaccagaacaaggtggtccgggtgcagcgccccgccaagaacgggaccgtgatggacgtcatctcccggcgcgaccagcggggcagcggccaggtggggacctacggcctgaacaccttcacgaacatggaggcccagctcatccgccagatggagtccgaggggatcttcagcccctccgagctggagacccccaacctggcggagcgggtgctcgactggctggagaagtacggcgtcgagcgcctgaagcggatggccatcagcggggacgactgcgtggtgaagccgatcgacgaccgcttcgccaccgccctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtgggccgcgcgcgggtgagccagggggccggctggtccctgcgcgagacggcctgcctgggcaagagctacgcccagatgtggcagctcatgtacttccaccggcgcgacctgcggctggcggccaacgccatctgctccgccgtccccgtggactggatccccaccagccgcaccacctggtccatccacgcccaccaccagtggatgacgaccgaggacatgctcagcgtgtggaaccgcgtctggatcgaggagaacccctggatggaggacaagacccacatctccagctggggcgacgtgccgtacctggggaagcgggaggaccagtggtgcggctccctgatcggcctcaccgcgcgcgccacgtgggccaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8839 - RNA, 9879 nt, synthetic construct
  misc_feature 1..9879: note = derived and/or modified CDS sequence (opt1) from DENV-1__JQ045667__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgcgatcggcaccagcatcacccagaaggggatcatcttcatcctcctgatgctggtgacgccctccatggccatgcggtgcgtcggcatcggcagccgcgacttcgtggaggggctctccggcgccacctgggtggacgtcgtgctggagcacgggagctgcgtgaccaccatggccaaggacaagcccacgctggacatcgagctcctgaagaccgaggtcaccaaccccgccatcctgcggaagctctgcatcgaggcgaagatctccaacaccacgaccaacagccgctgcccgacccagggcgaggccaccctggtggaggagcaggacgccaacttcgtgtgccggcgcacgttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacacgggcgaccagcaccaggtcgggaacgagtccaccgagcacggcaccaccgccaccatcacgccccaggcgcccaccaccgagatccagctcaccgactacggggccctgacgctggactgcagcccccgcaccggcctcgacttcaacgagatggtgctgctgaccatgaaggggaagtcctggctcgtccacaagcagtggttcctggacctgcccctcccctggaccagcggcgccagcacgtcccaggagacctggaaccggcaggacctgctggtgaccttcaagaccgcccacgccaagaagcaggaggtggtcgtgctcggcagccaggagggggcgatgcacacggccctgaccggcgccaccgagatccagacctccgggacgaccaccatcttcgccggccacctgaagtgccgcctcaagatggacaagctgaccctgaaggggatgagctacgtgatgtgcacgggctccttcaagctcgagaaggaggtcgccgagacccagcacggcaccgtgctggtgcagatcaagtacgaggggaccgacgcgccctgcaagatccccttcagcacgcaggacgagaagggcgtcacccagaacgggcggctgatcaccgccaacccgatcgtgaccgacaaggagaagcccgtgaacatcgaggccgagccgcccttcggcgagtcctacatcgtcatcggcgccggggagaaggcgctgaagctcagctggttcaagaagggctccagcatcgggaagatgttcgaggccacggcccgcggcgcccggcgcatggccatcctgggggacaccgcgtgggacttcggctccatcggcggggtgttcaccagcgtgggcaagctggtccaccagatcttcgggaccgcctacggcgtcctcttctccggggtgagctggacgatgaagatcggcatcggcgtcctgctgacctggctcgggctgaactcccgcagcacctccctgagcatgacctgcatcgccgtgggcctcgtgacgctgtacctgggggtcatggtgcaggccgactccggctgcgtgatcaactggaaggggcgggagctcaagtgcggcagcggcatcttcgtcaccaacgaggtgcacacctggaccgagcagtacaagttccaggccgacagcccgaagcgcctgtccgcggccatcgggaaggcctgggaggagggcgtgtgcgggatccggagcgccacccgcctggagaacatcatgtggaagcagatctccaacgagctcaaccacatcctgctggagaacgacatgaagttcacggtcgtggtgggcgacgtcgccgggatcctcgcgcagggcaagaagatgatccggccccagcccatggagtacaagtacagctggaagtcctggggcaaggccaagatcatcggggccgacgtgcagaacaccaccttcatcatcgacggccccaacaccccggagtgccccgacgaccagcgcgcctggaacatctgggaggtggaggactacgggttcggcatcttcacgaccaacatctggctgaagctgcgggacagctacacccaggtctgcgaccaccgcctcatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctgtggagcaacggggtcctcgagtccgagatgatcatccccaagatctacggcgggccgatcagccagcacaactaccgccccggctacttcacccagaccgccgggccctggcacctgggcaagctggagctcgacttcgacctgtgcgagggcacgaccgtggtggtcgacgagcactgcgggaaccggggcccgtccctgcgcaccaccacggtgaccgggaagatcatccacgagtggtgctgccggagctgcaccctgccgcccctccgcttccggggcgaggacgggtgctggtacggcatggagatccgccccgtgaaggagaaggaggagaacctggtcaagtccatggtgagcgccggcagcggggaggtggactccttcagcctcggcctgctgtgcatctccatcatgatcgaggaggtcatgcggagccgctggtcccggaagatgctcatgaccgggacgctggccgtgttcttcctgctcatcatgggccagctgacctggaacgacctgatccgcctctgcatcatggtgggggccaacgcgagcgaccgcatgggcatgggcaccacctacctggccctgatggccacgttcaagatgcggccgatgttcgccgtcgggctcctgttccgccggctgacctcccgcgaggtgctcctgctgaccatcggcctcagcctggtggcctccgtcgagctgcccaacagcctcgaggagctgggggacggcctggcgatgggcatcatgatcctcaagctgctgaccgacttccagtcctaccagctctgggccacgctgctgagcctcaccttcatcaagaccaccttctccctgcactacgcctggaagacgatggccatggtgctgagcatcgtctccctcttccccctgtgcctgagcaccacctcccagaagaccacgtggctccccgtgctgctggggagcctcggctgcaagccgctgaccatgttcctgatcgcggagaacaagatctgggggcggcgctcctggcccctcaacgagggcatcatggccgtggggatcgtcagcatcctgctgagctccctcctgaagaacgacgtgcccctggccggccccctcatcgccggcgggatgctgatggcctgctacgtgatcagcggctccagcgcggacctgtccctcgagaaggccgccgaggtcagctgggaggaggaggccgagcactccggggccagccacaacatcctggtggaggtgcagggcgacgggaccatgaagatcaaggacgaggagcgggacgacaccctgaccatcctcctgaaggcgacgctgctcgccgtctccggcgtgtacccgctgagcatccccgccaccctgttcgtgtggtacttctggcagaagaagaagcagcgctccggcgtcctctgggacacccccagcccgcccgaggtggggcgggccgtgctggacgacggcatctaccgcatcatgcagcgggggctgctgggccgctcccaggtcggggtgggcgtgttccaggagaacgtcttccacaccatgtggcacgtgacgcggggcgccgtgctcatgtaccaggggaagcgcctggagcccagctgggcgtccgtcaagaaggacctgatcagctacggcgggggctggcggctccaggggtcctggaacaccggcgaggaggtccaggtgatcgccgtcgagcccggcaagaaccccaagaacgtgcagaccgcccccgggaccttcaagacgcccgagggcgaggtgggggccatcgccctggacttcaagcccggcaccagcggctcccccatcgtcaaccgcgaggggaagatcgtgggcctgtacgggaacggcgtggtcaccaccagcgggacgtacgtgagcgcgatcgcccaggccaaggcctcccaggagggcccgctccccgagatcgaggacgaggtgttccggaagcgcaacctgaccatcatggacctgcaccccggcagcgggaagacccggcgctacctcccggcgatcgtccgggaggccatcaagcgcaagctgcgcaccctgatcctcgcccccacgcgggtggtggcctccgagatggccgaggcgctgaagggcatgcccatccgctaccagaccaccgccgtcaagagcgagcacaccgggaaggagatcgtggacctgatgtgccacgccacgttcaccatgcggctcctgtcccccgtgcgcgtcccgaactacaacatgatcatcatggacgaggcccacttcaccgaccccagctccatcgccgcgcggggctacatcagcacccgcgtggggatgggcgaggccgccgccatcttcatgacggccacgccgcccggctccgtggaggcgttcccgcagagcaacgccgtcatccaggacgaggagcgggacatccccgagcgctcctggaacagcgggtacgagtggatcaccgacttccccggcaagaccgtgtggttcgtgccctccatcaagagcgggaacgacatcgccaactgcctgcggaagaacggcaagcgcgtcatccagctctcccggaagacgttcgacaccgagtaccagaagaccaagaacaacgactgggactacgtggtgaccacggacatcagcgagatgggggccaacttccgcgcggaccgggtcatcgacccgcgccggtgcctgaagcccgtgatcctgaaggacggccccgagcgcgtgatcctcgccggccccatgccggtcaccgtggcctccgccgcccagcggcgcgggcggatcggccgcaaccacaacaaggagggggaccagtacatctacatgggccagcccctgaacaacgacgaggaccacgcgcactggaccgaggccaagatgctgctcgacaacatcaacacccccgaggggatcatccccgccctgttcgagccggagcgcgagaagtccgccgccatcgacggcgagtaccggctgcgcggcgaggcgcggaagacgttcgtcgagctcatgcgccgcggggacctgcccgtgtggctgtcctacaaggtggccagcgagggcttccagtacagcgaccgccggtggtgcttcgacggggagcgcaacaaccaggtcctcgaggagaacatggacgtggagatctggaccaaggagggcgagcggaagaagctgcgcccccggtggctggacgcccgcacctactccgaccccctcgccctgcgggagttcaaggagttcgccgcgggccgccggagcgtgtccggggacctgatcctcgagatcggcaagctgccgcagcacctgacccagcgcgcccagaacgccctcgacaacctggtcatgctgcacaacagcgagcagggcgggcgggcctaccgccacgcgatggaggagctccccgacacgatcgagaccctgatgctgctcgccctgatcgccgtgctgaccgggggcgtgaccctcttcttcctgtccggccgggggctgggcaagaccagcatcgggctcctgtgcgtcatggcctccagcgtgctgctctggatggcctccgtggagccccactggatcgcggccagcatcatcctggagttcttcctgatggtcctcctgatccccgagccggaccgccagcggacgccccaggacaaccagctggcctacgtggtgatcggcctcctgttcatgatcctgaccgtcgccgccaacgagatggggctcctggagaccaccaagaaggacctgggcatcggccacgtggcggtggagaaccaccaccacgccgccatgctcgacgtcgacctgcaccccgcctccgcctggacgctgtacgcggtggccaccaccatcatcaccccgatgatgcgccacacgatcgagaacaccaccgccaacatcagcctcaccgccatcgccaaccaggcggccatcctgatggggctggacaagggctggcccatctccaagatggacatcggggtgcccctcctggccctgggctgctacagccaggtcaaccccctcacgctgaccgccgcggtgctgatgctcgtggcccactacgccatcatcgggccgggcctgcaggccaaggccacccgcgaggcgcagaagcggaccgccgccggcatcatgaagaaccccacggtcgacgggatcgtggccatcgacctggaccccgtggtctacgacgccaagttcgagaagcagctcggccagatcatgctgctgatcctctgcacctcccagatcctgctgatgcgcaccacctgggcgctctgcgagagcatcacgctggccaccgggcccctgaccaccctctgggagggctccccgggcaagttctggaacacgaccatcgccgtgagcatggccaacatcttccgggggtcctacctggccggcgcggggctggccttcagcctcatgaagtccctgggcgggggccgccggggcaccggggcccagggcgagaccctgggggagaagtggaagcgccagctcaaccagctgtccaagagcgagttcaacatctacaagcggtccggcatcatggaggtggaccgcagcgaggccaaggaggggctgaagcggggcgagacgaccaagcacgcggtctcccgcggcaccgccaagctccggtggttcgtggagcgcaacctggtgaagcccgaggggaaggtcatcgacctgggctgcgggcggggcgggtggagctactactgcgccggcctgaagaaggtgaccgaggtgaagggctacacgaagggcgggcccgggcacgaggagcccatcccgatggccacctacggctggaacctcgtcaagctgcactccgggaaggacgtgttcttcatcccgcccgagaagtgcgacaccctgctctgcgacatcggcgagagctcccccaacccgaccatcgaggagggccgcacgctgcgggtgctgaagatggtcgagccctggctccgcgggaaccagttctgcatcaagatcctgaacccctacatgcccagcgtggtggagaccctggagcagatgcagcggaagcacggcgggatgctcgtccgcaacccgctgtcccggaacagcacccacgagatgtactgggtgtcctgcggcaccggcaacatcgtgagcgccgtcaacatgacctcccgcatgctgctcaaccgcttcacgatggcgcaccggaagcccacctacgagcgcgacgtggacctgggggccggcacccggcacgtggccgtcgagcccgaggtggccaacctggacatcatcgggcagcgcatcgagaacatcaagcacgagcacaagagcacctggcactacgacgaggacaacccctacaagacgtgggcctaccacggctcctacgaggtgaagccgagcgggtccgcgagcagcatggtcaacggcgtggtcaagctcctgaccaagccctgggacgtgatccccatggtgacccagatcgccatgaccgacacgacccccttcggccagcagcgggtcttcaaggagaaggtggacacccgcaccccgaaggccaagcgggggacgatccagatcatggaggtgaccgccaagtggctgtggggcttcctctcccgcaacaagaagccccggatctgcacccgcgaggagttcacccggaaggtccgcagcaacgccgcgatcggggccgtgttcgtggacgagaaccagtggaactccgccaaggaggccgtcgaggacgagcggttctgggacctggtgcaccgcgagcgggagctgcacaagcagggcaagtgcgcgacgtgcgtgtacaacatgatggggaagcgcgagaagaagctcggcgagttcggcaaggccaaggggagccgggccatctggtacatgtggctgggcgcccgcttcctggagttcgaggccctcgggttcatgaacgaggaccactggttctcccgggagaacagcctgtccggcgtcgagggggagggcctgcacaagctcggctacatcctgcgcgacatcagcaagatccccgggggcaacatgtacgcggacgacaccgccgggtgggacacccggatcaccgaggacgacctgcagaacgaggcccgcatcacggacatcatggagccggagcacgccctcctggccaagtccatcttcaagctgacctaccagaacaaggtggtgcgcgtccagcggcccgcgaagaacggcaccgtgatggacgtgatcagccgccgggaccagcgcggctccgggcaggtcggcacctacgggctcaacacgttcaccaacatggaggcccagctgatccggcagatggagagcgagggcatcttctcccccagcgagctggagacccccaacctcgccgagcgcgtgctggactggctggagaagtacggggtggagcggctcaagcgcatggccatctccggcgacgactgcgtcgtgaagccgatcgacgaccggttcgccaccgcgctgacggccctgaacgacatgggcaaggtgcgcaaggacatcccccagtgggagcccagcaaggggtggaacgactggcagcaggtccccttctgctcccaccacttccaccagctcatcatgaaggacggccgggagatcgtggtgccgtgccgcaaccaggacgagctggtcgggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgcggtgcccgtcgactggatccccacctcccggaccacgtggagcatccacgcccaccaccagtggatgaccaccgaggacatgctgtccgtgtggaaccgcgtgtggatcgaggagaacccctggatggaggacaagacccacatcagctcctggggcgacgtcccgtacctggggaagcgcgaggaccagtggtgcggcagcctcatcgggctgacggcccgggccacctgggccaccaacatccaggtggcgatcaaccaggtgcgccggctgatcggcaacgagaactacctcgactacatgacctccatgaagcgcttcaagaacgagagcgaccccgagggggccctgtggtga

SEQ ID NO: 8840 - RNA, 9879 nt, synthetic construct
  misc_feature 1..9879: note = derived and/or modified CDS sequence (opt1) from DENV-1__KU094071__SS-prME
  source 1..9879: mol_type = other RNA
agcgtgaccatgctgctcatgctgctgcccaccgccctcgccttccacctgacgacccgcggcggggagccgcacatgatcgtctccaagcaggagcggggcaagagcctgctcttcaagacctccgcgggggtgaacatgtgcaccctgatcgccatggacctgggcgagctctgcgaggacacgatgacctacaagtgcccccgcatcaccaaggccgagcccgacgacgtggactgctggtgcaacgccaccgacacgtgggtcacctacgggacctgcagccagaccggcgagcaccggcgcgacaagcggtccgtggccctggcgccccacgtgggcctggggctcgagacgcgcgccgagacctggatgagctccgagggcgcctggaagcagatccagaaggtcgagacctgggccctgcggcacccggggttcaccgtgatcgcgctgttcctcgcccacgccatcggcacgagcatcacccagaaggggatcatcttcatcctgctgatgctcgtgaccccctccatggccatgcgctgcgtcggcatcggcaaccgggacttcgtggaggggctgagcggcgggacctgggtggacgtcgtgctggagcacggctcctgcgtgacgaccatggccaaggacaagcccaccctcgacatcgagctgctgaagaccgaggtcacgaaccccgcggtgctccgcaagctgtgcatcgaggccaagatcagcaacaccaccaccgactcccggtgcccgacgcagggcgaggccaccctggtggaggagcaggacgccaacttcgtctgccgccggaccttcgtggaccgcgggtggggcaacgggtgcggcctcttcgggaagggcagcctgatcacctgcgccaagttcaagtgcgtgacgaagctggagggcaagatcgtccagtacgagaacctcaagtactccgtgatcgtgaccgtccacaccggggaccagcaccaggtgggcaacgagaccacggagcacgggaccatcgcgaccatcaccccccaggcccccaccagcgagatccagctgacggactacggcgccctgaccctcgactgctccccccggaccgggctggacttcaacgagatggtcctgctcaccatgaagcgcaagagctggctggtgcacaagcagtggttcctggacctcccgctgccctggacgtccggcgccagcaccccccaggagacctggaaccgggaggacctgctcgtgaccttcaagacggcccacgcgaagaagcaggaggtcgtggtgctgggcagccaggagggggccatgcacaccgccctgaccggcgccaccgagatccagacgtccgggaccaccaagatcttcgccggccacctcaagtgccgcctgaagatggacaagctgaccctcaaggggatgagctacgtcatgtgcacgggctccttcaagctggagaaggaggtggcggagacccagcacggcaccgtgctggtccaggtgaagtacgaggggaccgacgccccctgcaagatcccgttcagcacgcaggacgagaagggcgtgacccagaacgggcggctgatcaccgccaaccccatcgtcaccgacaaggagaagcccgtgaacatcgaggccgagcccccgttcggcgagtcctacatcgtggtcggcgcgggggagaaggccctcaagctgagctggttcaagaagggctccagcatcgggaagatgctggaggccacggcccgcggcgcccggcgcatggcgatcctcggggacaccgcctgggacttcggctccatcggcggggtgttcaccagcgtgggcaagctggtccaccagatcttcgggaccgcctacggcgtgctgttctccggggtgagctggacgatgaagatcggcatcggcatcctcctgacctggctggggctcaactcccgcagcgcctccctgagcatgacctgcatcgccgtcggcatggtgaccctgtacctcggggtgatggtccaggcggactccggctgcgtgatcaactggaaggggcgggagctgaagtgcggcagcggcatcttcgtgacgaacgaggtccacacctggaccgagcagtacaagttccgcgccgactcccccaagcggctgagcgccgccatcgggaaggcctgggaggagggcgtgtgcgggatccgcagcgcgacccggctcgagaacatcatgtggaagcagatctccaacgagctgaaccacatcctgctcgagaacgacatgaagttcacggtggtcgtgggcgacgtgagcgggatcctgacccagggccgcaagatgatcggcccccagcccatggagcacaagtactcctggaagagctgggggaaggccaagatcatcggcgccgacgtccagaacaccaccttcatcatcgacgggccgaacacccccgagtgccccgacgaccagcgggcctggaacatctgggaggtggaggactacggcttcggcatcttcacgaccaacatctggctgaagctccgcgactcctacacccaggtgtgcgacccccggctgatgagcgcggccatcaaggactccaaggccgtccacgccgacatggggtactggatcgagagcgagaagaacgagacctggcgcctggcccgggcgtccttcatcgaggtgaagacgtgcgtgtggccgaagagccacaccctctggtccaacggcgtcctggagagcgagatgatcatccccaagatctacgggggccccatctcccagcacaactaccgcccggggtacagcacccagaccgccggcccctggcacctgggcaagctcgagctggacttcgacctgtgcgaggggacgaccgtggtggtcgacgagcactgcggcaaccgggggccctccctccgcaccaccacggtgaccggcaagatcatccacgagtggtgctgccggagctgcaccctgcccccgctgcgcttcaagggggaggacggctgctggtacggcatggagatccggcccgtgaaggacaaggaggagaacctcgtcaagtccctggtgagcgccgggagcggcgaggtggactccttcagcctggggctcctgtgcgtctccatcatgatcgaggaggtgatgcgcagccggtggtcccgcaagatgctgatgaccggcacgctcgccgtgttcctgctgctcatcatggggcagctgacctggaacgacctgatccgcctctgcatcatggtcggcgccaacgcgagcgaccggatgggcatggggaccacctacctggccctgatcgccacgttcaagatgcgccccatgttcgccgtgggcctcctgttccggcgcctgacctcccgggaggtcctcctgctgaccatcgggctcagcctggtggcctccgtggagctgcccaacagcctcgaggagctgggcgacggcctggcgatggggatcatgatcctcaagctgctgaccgacttccagtcccaccagctctgggccgccctgctgagcctcacgttcatcaagaccaccttctccctgcactacgcctggaagaccatggcgatggtcctgagcacggtgtccctcttcccgctgtgcctgagcaccacctcccgcaagaccacgtggctccccgtgctgctgggcagcctcgggtgcaagcccctgaccatgttcctgatcgccgagaacaagatctggggccggaagtcctggcccctcaacgaggggatcatggccgtcggcatcgtgagcatcctgctgagctccctcctgaagaacgacgtgccgctggccggccccctcatcgccgggggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgacgatcctcctgaaggccaccctgctcgccgtgtccggcgtgtaccccatcagcatccccgccaccctgttcgtctggtacttccggcagaagaagaagcagcgctccggcgtgctgtgggacaccccgagcccccccgaggtggagcgggccgtcctggacgacgggatctaccgcatcctccagcggggcctgctggggcgctcccaggtgggcgtgggggtcttccaggagggcgtgttccacaccatgtggcacgtgacgcggggcgcggtcctcatgtaccaggggaagcgcctggagcccagctgggcctccgtgaagaaggacctgatcagctacggcgggggctggcggttccaggggtcctggaacaccggcgaggaggtgcaggtcatcgccgtggagccgggcaagaaccccaagaacgtgcagaccgcccccgggaccttcaagacgcccgagggcgaggtcggggtgatcgccctcgacttcaagccgggcaccagcggctcccccatcgtgaaccgcgaggggaagatcgtcggcctgtacgggaacggcgtggtgaccaccagcgggacgtacgtcagcgcgatcgcccaggccaaggcctcccaggagggccccctgccggagatcgaggacgaggtgttccggaagcgcaacctcaccatcatggacctgcaccccggcagcgggaagacccggcgctacctgcccgcgatcgtgcgcgaggccatcaagcggaagctccgcaccctgatcctggcccccacgcgggtcgtggcctccgagatggccgaggcgctcaagggcatgccgatccgctaccagaccaccgccgtgaagagcgagcacaccgggcgggagatcgtcgacctgatgtgccacgccacgttcaccatgcgcctgctctcccccgtgcgggtgcccaactacaacatgatcatcatggacgaggcccacttcaccgaccccgccagcatcgcggcccgcggctacatctccacccgggtcgggatgggcgaggccgccgccatcttcatgacggcgaccccgcccggcagcgtggaggccttcccccagtccaacgccgtgatccaggacgaggagcgcgacatccccgagcggagctggaactccgggtacgactggatcaccgacttcccgggcaagaccgtctggttcgtgcccagcatcaagtccgggaacgacatcgccaactgcctgcgcaagaacggcaagcgggtgatccagctgagccgcaagacgttcgacaccgagtaccagaagaccaagaacaacgactgggactacgtcgtgaccacggacatctccgagatgggggcgaacttccgggccgaccgcgtcatcgacccccggcgctgcagcaagcccgtgatcctcaaggacggcccggagcgggtgatcctggccggccccatgcccgtcaccgtggcctccgccgcgcagcgccgcgggcggatcggccgcaaccagaacaaggagggggaccagtacatctacatgggccagcccctgaacaacgacgaggaccacgcccactggaccgaggccaagatgctcctggacaacatcaacaccccggaggggatcatccccgccctgttcgagcccgagcggggcaagagcgccgcgatcgacggcgagtaccgcctccggggggaggcccgcaagacgttcgtggagctgatgcggcgcggcgacctgcccgtctggctctcctacaaggtggccagcgaggggttccagtacagcgaccggaagtggtgcttcgacggcgagcgcaacaaccaggtgctggaggagaacatggacgtcgagatctggaccaaggagggcgagcggaagaagctgcgcccgcggtggctcgacgcccgcacctactccgacccccaggccctgcgggagttcaaggagttcgcggccgggcgccggagcgtgtccggcgacctgatcctcgagatcgggaagctgccccagcacctgacccagcgcgcccagaacgccctcgacaacctggtgatgctgcacaacagcgagcagggcgggaaggcgtaccggcacgccatggaggagctccccgacacgatcgagaccctgatgctgctcgccctgatcgccgtcctgaccggcggcgtgaccctcttcttcctgtccgggcgcggcctggggaagacgagcatcggcctcctgtgcgtgatggcctccagcgtcctgctctgggtggcgtccgtggagccgcactggatcgccgccagcatcatcctggagttcttcctgatggtcctcctgatccccgagcccgaccggcagcgcaccccgcaggacaaccagctggcctacgtggtgatcgggctcctgttcatgatcctgaccgtcgccgcgaacgagatgggcctcctggagaccaccaagaaggacctgggcatcgggcacgtggccgtggagaaccaccaccacgccacgatgctcgacgtcgacctgcgccccgcctccgcctggaccctgtacgcggtggccaccaccatcatcacgcccatgatgcggcacaccatcgagaacaccaccgccaacatcagcctcacggccatcgccaaccaggcggccatcctgatgggcctggacaaggggtggcccatctccaagatggacatcggcgtgccgctcctggccctggggtgctacagccaggtcaacccccccaccctcatcgccgcggtgctgatgctggtggcccactacgccatcatcggccccggcctccaggccaaggccacccgcgaggcgcagaagcggaccgccgccgggatcatgaagaacccgacggtcgacggcatcgtggccatcgacctggaccccgtggtctacgacgccaagttcgagaagcagctggggcagatcatgctcctgatcctgtgcacctcccagatcctcagcatgcgcaccacctgggcgctgtgcgagtccatcacgctggccaccggccccctcaccaccctgtgggagggcagccccgggaagttctggaacacgaccatcgccgtgtccatggccaacatcttccggggcagctacctggccggggcgggcctcgccttcccgctgatgaagagcctggggggcggccgccgggggaccggcgcccagggggagaccctcggcgagaagtggaagcgccagctgaaccagctgtccaagagcgagttcaacacgtacaagcggtccgggatcatggaggtggaccgcagcgaggccaaggagggcctcaagcggggcgagaccaccaagcacgcggtctcccgcgggaccgccaagctgcggtggttcgtggagcgcaacctggtgaagcccgagggcaaggtcatcgacctcgggtgcggccgggggggctggagctactactgcgccggcctgaagaaggtgacggaggtgaaggggtacaccaagggcgggcccggccacgaggagcccatcccgatggccacctacgggtggaacctggtcaagctgcactccggcaaggacgtgttcttcaccccccccgagaagtgcgacacgctcctgtgcgacatcggcgagagctcccccaacccgaccatcgaggaggggcgcaccctgcgggtgctcaagatggtcgagccctggctgcgcggcaaccagttctgcatcaagatcctgaacccctacatgcccagcgtggtggagaccctcgagcagatgcagcggaagcacgggggcatgctggtccgcaacccgctgtcccgcaacagcacgcacgagatgtactgggtgtcctgcggcaccgggaacatcgtgagcgccgtcaacatgacctcccggatgctcctgaaccgcttcaccatggcgcaccggaagcccacctacgagcgcgacgtggacctgggcgccgggacgcggcacgtcgccgtggagcccgaggtggccaacctcgacatcatcggccagcgcatcgagaacatcaagaacgagcacaagagcacctggcactacgacgaggacaacccctacaagacctgggcctaccacgggtcctacgaggtcaagccgagcggctccgcgagcagcatggtgaacggcgtggtccggctgctgaccaagccctgggacgtgatccccatggtgacgcagatcgccatgaccgacaccaccccgttcgggcagcagcgcgtcttcaaggagaaggtggacacgcggacccccaaggccaagcgcggcaccgcccagatcatggaggtgaccgcccggtggctctgggggttcctgtcccgcaacaagaagccccggatctgcacgcgcgaggagttcacccggaaggtccgcagcaacgcggccatcggcgccgtgttcgtggacgagaaccagtggaactccgccaaggaggcggtcgaggacgagcggttctgggacctggtgcaccgcgagcgggagctccacaagcaggggaagtgcgccacctgcgtgtacaacatgatgggcaagcgcgagaagaagctgggcgagttcgggaaggccaagggcagccgggccatctggtacatgtggctgggggcccgcttcctcgagttcgaggcgctgggcttcatgaacgaggaccactggttctcccgcgagaacagcctgtccggggtcgagggcgagggcctccacaagctggggtacatcctgcgggacatcagcaagatccccggcgggaacatgtacgccgacgacaccgccggctgggacacgcgcatcaccgaggacgacctccagaacgaggccaagatcaccgacatcatggagccggagcacgccctgctggcgacctccatcttcaagctcacgtaccagaacaaggtggtgcgggtccagcgccccgccaagaacggcaccgtgatggacgtgatcagccggcgcgaccagcgggggtccggccaggtcgggacctacggcctgaacaccttcacgaacatggaggtgcagctgatccgccagatggagagcgaggggatcttctcccccagcgagctcgagacccccaacctggccgagcgggtgctggactggctcgagaagcacggcgtcgagcgcctgaagcggatggccatctccggcgacgactgcgtggtgaagccgaccgacgaccgcttcgccaccgcgctgacggccctcaacgacatggggaaggtccggaaggacatcccccagtgggagcccagcaagggctggaacgactggcagcaggtgcccttctgctcccaccacttccaccagctgatcatgaaggacgggcgcgagatcgtggtcccgtgccggaaccaggacgagctggtgggccgcgcccgggtgagccagggggccggctggagcctccgcgagaccgcctgcctgggcaagtcctacgcgcagatgtggcagctgatgtacttccaccggcgcgacctccgcctggccgccaacgccatctgcagcgcggtccccatcgactgggtgcccacctcccggaccacgtggagcatccacgcccaccaccagtggatgaccaccgaggacatgctgtccgtgtggaaccgcgtctggatcgaggagaacccctggatggaggacaagacccacgtgagctcctgggaggacgtgccgtacctcgggaagcgggaggaccagtggtgcggcagcctgatcgggctgacggcccgcgccacctgggccaccaacatccaggtcgcgatcaaccaggtgcggcgcctcatcggcaacgagaactacctggactacatgacctccatgaagcggttcaaggacgagagcgacctggagggggccctctggtga

SEQ ID NO: 8841 - RNA, 9879 nt, synthetic construct
  misc_feature 1..9879: note = derived and/or modified CDS sequence (opt1) from DENV-1__HQ624983__SS-prME
  source 1..9879: mol_type = other RNA
agcgtgaccatgctgctcatgctggtgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccggatcagcgaggccgagcccgacgacgtcgactgctggtgcaacgccaccgacacctgggtgacctacgggacctgctcccagaccggcgagcaccggcgcgacaagcggagcgtggccctggcgccccacgtcggcctcgggctggagacccggacggagacctggatgtccagcgagggcgcctggaagcagatccagcgggtggagacctgggccctgcgccaccccgggttcaccgtgatcgccctcttcctggcgcacgccatcggcacgtccatcacccagaaggggatcatcttcatcctgctcatgctggtcacccccagcatggccatgcggtgcgtgggcatcggctcccgcgacttcgtggaggggctgagcggcgccacctgggtcgacgtggtgctcgagcacgggtcctgcgtcacgaccatggccaaggacaagcccaccctggacatcgagctgctcaagaccgaggtgacgaaccccgcggtgctgcggaagctgtgcatcgaggccaagatcagcaacaccaccaccgactcccgctgcccgacgcagggcgaggccaccctcgtcgaggagcaggacgccaacttcgtgtgccggcgcaccttcgtggaccggggctgggggaacggctgcgggctgttcggcaaggggagcctgatcacgtgcgccaagttcaagtgcgtcacgaagctcgagggcaagatcgtgcagtacgagaacctgaagtactccgtgatcgtcaccgtgcacaccggcgaccagcaccaggtcgggaacgagagcaccgagcacggcacgaccgcgaccatcacgccccaggccccctccaccgagatccagctgacggactacggggccctcaccctggactgcagcccccgcaccggcctggacttcaacgagatggtgctcctgaccatgaaggagaagtcctggctggtgcacaagcagtggttcctcgacctgccgctgccctggacgtccggggccagcacctcccaggagacctggaaccggcaggacctcctggtcaccttcaagacggcccacgcgaagaagcaggaggtggtggtcctgggcagccaggagggcgccatgcacaccgccctcaccggggccaccgagatccagacgtccggcaccaccaccatcttcgccgggcacctgaagtgccgcctgaagatggacaagctcacgctgaagggcatgagctacgtgatgtgcaccgggtccttcaagctggagaaggaggtggcggagacccagcacggcaccgtcctcgtgcagatcaagtacgagggcacggacgccccctgcaagatccccttcagcacccaggacgagaagggggtgacccagaacggccggctgatcaccgccaacccgatcgtcacggacaaggagaagcccgtgaacatcgaggccgagccgcccttcggggagtcctacatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtcttcaccagcgtggggaagctggtgcaccagatcttcggcacggcctacggggtcctgttctccggcgtgagctggaccatgaagatcgggatcggcgtgctcctgacctggctgggcctcaactcccgcagcacctccctgagcatgacgtgcatcgccgtcgggctggtgaccctctacctgggcgtgatggtccaggccgacagcgggtgcgtgatcaactggaagggccgggagctgaagtgcgggtccggcatcttcgtgaccaacgaggtccacacctggacggagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtggtcgtgggggacgtggcgggcatcctggcccaggggaagaagatgatccggccccagcccatggagtacaagtacagctggaagtcctggggcaaggccaagatcatcggcgccgacgtccagaacaccaccttcatcatcgacgggcccaacacgccggagtgccccgacgaccagcgcgcgtggaacatctgggaggtggaggactacggcttcgggatcttcaccaccaacatctggctcaagctgcgggacagctacacccaggtgtgcgaccaccgcctgatgtccgccgccatcaaggacagcaaggccgtccacgccgacatgggctactggatcgagtccgagaagaacgagacgtggaagctcgcgcgggccagcttcatcgaggtgaagacctgcatctggcccaagtcccacaccctgtggagcaacggcgtgctggagtccgagatgatcatccccaagatctacgggggcccgatcagccagcacaactaccgccccgggtacttcacccagacggccggcccctggcacctcgggaagctggagctggacttcgacctctgcgagggcaccaccgtcgtggtggacgagcactgcggcaaccgggggccgtccctgcgcaccacgaccgtcaccggcaagatcatccacgagtggtgctgccggagctgcaccctgccgcccctgcgcttcaagggggaggacggctgctggtacgggatggagatccggcccgtgaaggagaaggaggagaacctggtcaagagcatggtctccgccggcagcggcgaggtggactccttcagcctggggctcctgtgcatctccatcatgatcgaggaggtgatgcgcagccggtggtcccgcaagatgctgatgacgggcaccctcgccgtcttcttcctgctgatcatggggcagctcacctggaacgacctgatccggctgtgcatcatggtgggcgcgaacgccagcgaccgcatggggatgggcatgacctacctcgccctgatggccacgttcaagatgcgcccgatgttcgccgtgggcctcctgttccggcgcctgacctcccgggaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggccacgctcctgagcctgaccttcatcaagaccaccttctccctccactacgcctggaagacgatggcgatggtgctgagcatcgtgtccctgttccccctctgcctgagcaccacctcccagaagaccacgtggctgcccgtcctcctgggcagcctggggtgcaagccgctcaccatgttcctgatcgccgagaacaagatctggggccgcaagagctggcccctgaacgaggggatcatggccgtgggcatcgtgtccatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgacgatcctgctcaaggccaccctgctggccgtgtccggcgtctacccgctcagcatccccgccaccctgttcgtgtggtacttctggcagaagaagaagcagcgctccggggtgctgtgggacacccccagcccgcccgaggtcgagcgggccgtgctcgacgacggcatctaccgcatcatgcagcggggcctgctggggcgctcccaggtgggcgtcggggtgttccaggagaacgtgttccacaccatgtggcacgtcacgcggggcgcggtgctgatgtaccaggggaagcgcctcgagcccagctgggcctccgtgaagaaggacctgatcagctacggcggcgggtggcggctgcagggctcctggaacaccggggaggaggtccaggtgatcgccgtggagcccggcaagaaccccaagaacgtccagaccgcccccgggaccttcaagacgagcgagggcgaggtgggcgccatcgcgctcgacttcaagcccgggaccagcggctcccccatcgtgaaccgcgaggggaagatcgtcggcctgtacggcaacggggtggtgaccaccagcggcacgtacgtctccgccatcgcccaggccaaggcgagccaggaggggcccctgccggagatcgaggacgaggtgttccggaagcgcaacctcaccatcatggacctgcaccccggctccgggaagacccggcgctacctgcccgccatcgtgcgggaggccatcaagcgcaagctccggaccctgatcctggccccgacgcgcgtcgtggccagcgagatggcggaggccctcaagggcatgcccatccgctaccagaccaccgccgtgaagtccgagcacaccggcaaggagatcgtcgacctgatgtgccacgccacgttcaccatgcggctgctcagccccgtgcgcgtgcccaactacaacatgatcatcatggacgaggcccacttcaccgacccgtccagcatcgcggcccgggggtacatctccacccgcgtcggcatgggggaggccgccgccatcttcatgacggcgacgccgcccggcagcgtggaggccttcccccagtccaacgccgtgatccaggacgaggagcgggacatcccggagcgcagctggaactccgggtacgagtggatcaccgacttccccggcaagaccgtctggttcgtgcccagcatcaagtccggcaacgacatcgccaactgcctgcggaagaacgggaagcgcgtgatccagctgagccggaagacgttcgacaccgagtaccagaagaccaagaacaacgactgggactacgtcgtgaccacggacatctccgagatgggcgcgaacttccgcgccgaccgggtgatcgacccccgccggtgcctcaagccggtcatcctgaaggacgggcccgagcgcgtgatcctggccggccccatgcccgtcaccgtggccagcgccgcgcagcggcgcgggcggatcggccgcaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgggagaagtccgccgcgatcgacggggagtaccgcctgcgcggcgaggcccggaagacgttcgtggagctgatgcgccgcggggacctcccggtctggctgtcctacaaggtggccagcgagggcttccagtactccgaccgccggtggtgcttcgacggcgagcgcaacaaccaggtgctggaggagaacatggacgtcgagatctggaccaaggagggggagcggaagaagctccgcccccggtggctggacgcccgcacctacagcgaccccctggccctccgggagttcaaggagttcgcggccggccgccggtccgtgagcggggacctgatcctggagatcggcaagctcccccagcacctgacccagcgcgcccagaacgccctggacaacctcgtgatgctgcacaactccgagcagggcgggcgggcgtaccgccacgccatggaggagctgccggacacgatcgagaccctcatgctgctggccctcatcgccgtcctgaccggcggggtgaccctgttcttcctcagcggccgggggctgggcaagacgtccatcggcctgctctgcgtgatggccagctccgtcctgctgtggatggcgagcgtggagccccactggatcgccgcctccatcatcctcgagttcttcctgatggtgctgctcatccccgagcccgaccgccagcggaccccgcaggacaaccagctggcctacgtcgtgatcgggctcctcttcatgatcctgaccgtggccgcgaacgagatgggcctgctcgagaccaccaagaaggacctggggatcggccacgtcgccgtggagaaccaccaccacgccgccatgctggacgtggacctccaccccgccagcgcgtggacgctgtacgccgtcgccaccaccatcatcacccccatgatgcgccacacgatcgagaacaccaccgccaacatctccctgaccgccatcgcgaaccaggccgccatcctcatggggctggacaagggctggccgatcagcaagatggacatcggcgtgcccctgctcgccctggggtgctactcccaggtgaaccccctgacgctcaccgcggccgtcctgatgctggtggcccactacgccatcatcggccccgggctccaggccaaggcgacccgggaggcccagaagcgcaccgccgccggcatcatgaagaacccgacggtggacgggatcgtcgccatcgacctggaccccgtggtgtacgacgcgaagttcgagaagcagctgggccagatcatgctcctgatcctgtgcaccagccagatcctcctgatgcgcaccacctgggccctgtgcgagtccatcacgctcgccaccggccccctgaccaccctgtgggaggggagccccggcaagttctggaacacgaccatcgccgtcagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccacctcagcaagtccgagttcaacacgtacaagcggagcgggatcatggaggtggaccgctccgaggcgaaggagggcctgaagcgcggggagaccaccaagcacgccgtgagccgcggcaccgccaagctgcggtggttcgtcgagcgcaacctcgtgaagccggaggggaaggtgatcgacctgggctgcggccgcggcgggtggtcctactactgcgccgggctgaagaaggtcacggaggtgaaggggtacaccaagggcggccccggccacgaggagcccatccccatggccacctacgggtggaacctggtgaagctccacagcggcaaggacgtcttcttcgtgccgcccgagaagtgcgacaccctgctgtgcgacatcggggagtccagccccaaccccacgatcgaggagggccgcaccctccgggtgctgaagatggtcgagccgtggctgcgcgggaaccagttctgcatcaagatcctcaacccctacatgccctccgtggtggagaccctggagcagatgcagcggaagcacggcggcatgctggtccgcaaccccctcagccggaactccacccacgagatgtactgggtgagctgcgggacgggcaacatcgtgtccgcggtcaacatgaccagccgcatgctgctgaaccggttcaccatggcccaccgcaagccgacctacgagcgcgacgtggacctcggggccggcacccggcacgtggccgtcgagcccgaggtggccaacctggacatcatcggccagcgcatcgagaacatcaagcacgagcacaagtccacgtggcactacgacgaggacaacccctacaagacctgggcgtaccacgggagctacgaggtcaagcccagcggctccgccagctccatggtgaacggggtggtcaagctgctcaccaagccgtgggacgtgatccccatggtgacccagatcgccatgacggacaccacccccttcggccagcagcgggtcttcaaggagaaggtggacacccgcacgcccaaggccaagcgggggaccgcccagatcatggaggtgaccgcgaagtggctgtggggcttcctgagccgcaacaagaagccgcggatctgcacccgcgaggagttcacgcggaaggtccgctccaacgccgccatcggcgccgtgttcgtggacgagaaccagtggaacagcgcgaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaaggggtcccgggccatctggtacatgtggctcggcgcgcgcttcctggagttcgaggccctgggcttcatgaacgaggaccactggttcagccgggagaactccctcagcggggtcgagggcgaggggctgcacaagctgggctacatcctccgcgacatctccaagatcagcgggggcaacatgtacgccgacgacaccgccggctgggacacccggatcacggaggacgacctgcagaacgaggccaagatcaccgacatcatggagcccgagcacgcgctgctcgccaactccatcttcaagctgacctaccagaacaaggtggtgcgcgtccagcggcccgccaagaacgggaccgtgatggacgtgatcagccgccgcgaccagcggggctccgggcaggtcggcacgtacggcctgaacaccttcaccaacatggaggcccagctcatccgccagatggagagcgaggggatcttctccccgagcgagctggagacccccaacctggccgagcgggtgctcgactggctggagaagtacggcgtggagcgcctgaagcggatggcgatcagcggggacgactgcgtcgtgaagcccatcgacgaccgcttcgccacggccctcaccgccctgaacgacatgggcaaggtgcggaaggacatcccccagtgggagccgtccaaggggtggaacgactggcagcaggtccccttctgcagccaccacttccaccagctgatcatgaaggacggccgcgagatcgtggtgccctgccggaaccaggacgagctcgtcggccgcgcccgggtgtcccagggggcgggctggagcctgcgcgagaccgcctgcctggggaagtcctacgcccagatgtggcagctcatgtacttccaccggcgcgacctgcggctggccgcgaacgccatctgcagcgccgtgcccgtcgactgggtgccgacctcccgcacgacctggagcatccacgcccaccaccagtggatgaccgccgaggacatgctctccgtgtggaaccgggtctggatcgaggagaacccctggatggaggacaagacccacatcagctcctgggaggacgtgccctacctgggcaagcgcgaggaccagtggtgcgggagcctgatcggcctcacggcgcgggccacctgggccaccaacatccaggtggccatcaaccaggtccgccgcctgatcggcaacgagaactacctggactacatgacctccatgaagcggttcaagaacgagagcgaccccgagggggccctctggtga

SEQ ID NO: 8842 - RNA, 9879 nt, synthetic construct
  misc_feature 1..9879: note = derived and/or modified CDS sequence (opt1) from DENV-1__FJ384655__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcacggtcgtggtgggggacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacgagcagcgggcctggaacatctgggaggtcgaggactacggcttcgggatcttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacgtgcatctggcccaagagccacaccctctggtccaacggcgtcctggagagcgagatgatcatccccaagatctacgggggcccgatctcccagcacaactaccggcccgggtacttcacccagaccgccggcccctggcacctggggaagctcgagctggacttcgacctgtgcgagggcacgaccgtggtggtcgacgagcactgcggcaaccgcgggccgagcctccggaccaccacggtgaccggcaagatcatccacgagtggtgctgccgctcctgcaccctgccgcccctgcggttccgcggggaggacggctgctggtacgggatggagatccggcccgtgaaggagaaggaggagaacctcgtccgcagcatggtgtccgccggcagcggcgaggtggacagcttctccctggggatcctgtgcgtcagcatcatgatcgaggaggtgatgcggtcccgctggagccggaagatgctcatgaccggcacgctggccgtgttcctgctcctgatcatggggcagctgacctggaacgacctcatccgcctgtgcatcatggtcggcgccaacgcgtccgacaagatggggatgggcaccacctacctggccctcatggccacgttcaagatgcgcccgatgttcgccgtgggcctgctgttccggcgcctcgccagccgggaggtgctgctgctcaccatcgggctgtccctggtcgcgagcgtggagctccccaactccctggaggagctgggcgacgggctcgccatgggcatcatgatgctgaagctgctcaccgagttccagccccaccacctgtggaccacgctgctcagcctgaccttcatcaagaccaccctgtccctcgactacgcctggaagacgaccgccatggtcctgagcatcgtgtccctgttccccctctgcctgagcaccacctcccagaagacgacctggctgccggtgctcctgggcagcttcgggtgcaagcccctgaccatgttcctcatcaccgagaacaagatctggggccgcaagtcctggcccctgaacgaggggatcatggcgatcggcatcgtcagcatcctgctctccagcctgctgaagaacgacgtgcccctcgccgggccgctgatcgccggcggcatgctgatcgcctgctacgtgatcagcgggtccagcgccgacctctccctggagaaggcggccgaggtcagctgggaggaggaggccgagcactccggcaccagccacaacatcctggtggaggtgcaggacgacggggccatgaagatcaaggacgaggagcgggacgacacgctcaccatcctgctgaaggccaccctcctggcggtctccggcgtgtaccccatgagcatccccgccaccctgttcgtgtggtacttctggcagaagaagaagcagcgctccggggtcctctgggacacgcccagcccgcccgaggtggagggcgccgtgctggacgacggcatctaccggatcctgcagcgcgggctgctcggccggtcccaggtcggggtgggcgtgttccaggacggggtcttccacaccatgtggcacgtgacccgcggcgccgtgctgatgtaccagggcaagcggctggagcccagctgggcctccgtcaagaaggacctcatcagctacgggggcgggtggcgcttccagggctcctggaacaccggggaggaggtccaggtgatcgcggtcgagcccggcaagaacccgaagaacgtgcagacgacccccggcaccttcaagacccccgagggggaggtgggcgccatcgccctggacttcaagcccgggacgagcggctccccgatcgtcagccgggagggcaagatcgtggggctgtacggcaacggggtggtcaccacctccggcacctacgtgagcgccatcgcccaggcgaaggccagccaggaggggcccctccccgagatcgaggacgaggtgttcaagaagcgcaacctgacgatcatggacctgcacccgggctccggcaagacccggcgctacctccccgccatcgtccgggaggccatcaagcgcaagctgcggaccctgatcctcgcgcccacccgcgtggtggccagcgagatggccgaggccctgaaggggatgcccatccggtaccagacgaccgccgtcaagtccgagcacaccggccgcgagatcgtggacctgatgtgccacgcgaccttcacgatgcgcctcctgagcccggtgcgggtccccaactacaacatgatcatcatggacgaggcccacttcaccgaccccgcctccatcgccgcccgcgggtacatcagcacccgggtgggcatgggggaggcggccgccatcttcatgaccgccacgcccccgggctccgtggaggccttcccccagagcaacgcggtcatccaggacgaggagcgcgacatccccgagcggtcctggaacagcggctacgactggatcaccgacttccccgggaagaccgtgtggttcgtgccgtccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgccaacttccgggccgaccgcgtcatcgacccccggcgctgcctgaagcccgtgatcctgaaggacgggcccgagcgggtgatcctcgcgggcccgatgcccgtcacggtggcctccgccgcccagcgccggggccgcatcgggcggaaccagaacaaggagggcgaccagtacgtctacatggggcagcccctgaacaacgacgaggaccacgcccactggaccgaggcgaagatgctgctcgacaacatcaacacccccgagggcatcatcccggccctgttcgagcccgagcgcgagaagtccgccgccatcgacgggggctaccggctgcgcggcgaggcccgcaagaccttcgtggagctcatgcggcgcggggacctgcccgtgtggctgtcctacaaggtcgcgagcgagggcttccagtactccgaccggcgctggtgcttcgacggggagcggaacaaccaggtgctcgaggagaacatggacgtggagatctggacgaaggagggcgagcgcaagaagctgcggccccgctggctggacgcccggacctacagcgacccgctcgccctgcgcgagttcaaggagttcgccgccggccggcgcagcgtctccggggacctgatcctcgagatcggcaagctgccccagcacctgaccctccgggcgcagaacgccctggacaacctggtgatgctccacaacagcgagcagggcgggaaggcctaccgccacgccatggaggagctgcccgacaccatcgagaccctgatgctcctggcgctgatcgccgtgctcaccggcggggtcaccctgttcttcctgtccgggaaggggctcggcaagaccagcatcgggctgctgtgcgtgaccgcctccagcgccctcctgtggatggcctccgtggagccccactggatcgcggccagcatcatcctggagttcttcctcatggtcctgctgatcccggagcccgaccggcagcgcacgccccaggacaaccagctcgcctacgtggtgatcggcctgctgttcatgatcctcaccgtcgccgccaacgagatggggctgctggagaccaccaagaaggacctcggcatcggccacgtggcggccgagaaccaccagcacgccacgatgctggacgtggacctgcggccggcctccgcctggaccctctacgcggtcgccaccaccgtgatcacgcccatgatgcgccacaccatcgagaacaccaccgccaacatcagcctgacggccatcgccaaccaggcggccatcctgatggggctcgacaagggctggcccatctccaagatggacatcggggtgcccctgctggccctcggctgctacagccaggtcaacccgctgaccctgaccgccgcggtgctcatgctggtggcccactacgccatcatcgggcccggcctgcaggccaaggccacccgggaggcgcagaagcgcacggccgccggcatcatgaagaaccccaccgtcgacgggatcgtggccatcgacctcgaccccgtggtctacgacgccaagttcgagaagcagctgggccagatcatgctgctcatcctgtgcacctcccagatcctgctcatgcggaccacgtgggcgctgtgcgagagcatcaccctggccaccgggccgctcaccacgctgtgggagggctcccccggcaagttctggaacaccaccatcgccgtgagcatggccaacatcttccgcgggtcctacctggccggcgcggggctcgccttcagcctgatgaagtccctgggcgggggccgccggggcaccggggcccagggcgagacgctcggggagaagtggaagcgccagctgaaccagctgagcaagagcgagttcaacacctacaagcggtccggcatcatggaggtggaccgcagcgaggccaaggaggggctcaagcggggcgagaccaccaagcacgcggtctcccgcggcacggccaagctgcggtggttcgtggagcgcaacctggtgaagcccgaggggaaggtcatcgacctgggctgcgggcggggcgggtggagctactactgcgccggcctcaagaaggtgaccgaggtgaagggctacaccaagggcgggcccgggcacgaggagccggtccccatggccacctacggctggaacctggtgaagctgcactccgggaaggacgtgttcttcatgccgcccgagaagtgcgacaccctcctgtgcgacatcggcgagagctccccgaaccccacgatcgaggagggccgcaccctgcgggtcctcaagatggtggagccctggctgcgcgggaaccagttctgcatcaagatcctgaacccctacatgccgagcgtggtcgagaccctcgagcagatgcagcggaagcacggcgggatgctggtgcgcaaccccctgtcccggaacagcacccacgagatgtactgggtgtcctgcggcacgggcaacatcgtcagcgccgtgaacatgacctcccgcatgctcctgaaccggttcaccatggcgcaccgcaagcccacctacgagcgggacgtggacctgggggccggcacgcgccacgtcgccgtggagcccgaggtggccaacctcgacatcatcgggcagcgcatcgagaacatcaagaacgagcacaagagcacctggcactacgacgaggacaacccgtacaagacctgggcctaccacggctcctacgaggtcaagcccagcgggtccgcgagctccatggtgaacggcgtcgtgcggctgctgaccaagccctgggacgtgatccccatggtcacgcagatcgccatgaccgacaccaccccgttcggccagcagcgcgtgttcaaggagaaggtggacacgcggacgccccgggccaagcgggggaccgcccagatcatggaggtcaccgccaagtggctctggggcttcctgagccgcaacaagaagccccggatctgcacgcgcgaggagttcacccggaaggtgcgcagcaacgcggccatcggggccgtgttcgtcgacgagaaccagtggaactccgccaaggaggcggtggaggacgagcggttctgggacctggtgcaccgcgagcgggagctccacaagcagggcaagtgcgcgacctgcgtctacaacatgatggggaagcgcgagaagaagctgggcgagttcggcaaggccaaggggagccgggccatctggtacatgtggctgggcgcccgcttcctcgagttcgaggcgctggggttcatgaacgaggaccactggttctcccgggagaacagcctgtccggcgtggagggggagggcctccacaagctgggctacatcctgcgcgacatcagcaagatccccggcgggaacatgtacgccgacgacaccgccgggtgggacacgcggatcaccgaggacgacctccagaacgaggccaagatcaccgacatcatggagcccgagcacgccctgctggcgacctccatcttcaagctcacgtaccagaacaaggtggtccgcgtgcagcggcccgccaagaacgggaccgtgatggacgtcatcagccgccgcgaccagcggggctccggccaggtgggcacctacgggctgaacaccttcacgaacatggaggtgcagctgatccgccagatggagagcgagggcatcttcctcccctccgagctggagaccccgaacctggccgagcgggtcctcgactggctggagaagcacggggccgagcgcctgaagcggatggccatcagcggcgacgactgcgtggtgaagcccatcgacgaccgcttcgcgaccgccctcatcgccctgaacgacatgggcaaggtccggaaggacatcccccagtgggagccctccaaggggtggaacgactggcagcaggtcccgttctgcagccaccacttccaccagctgatcatgaaggacggccgcgagatcgtggtcccctgccggaaccaggacgagctcgtggggcgcgcccgggtgtcccagggcgccgggtggagcctgcgcgagaccgcgtgcctgggcaagtcctacgcccagatgtggcagctcatgtacttccaccggcgcgacctgcggctggccgccaacgcgatctgcagcgccgtccccgtggactgggtgcccacgagccgcaccacctggtccatccacgcccaccaccagtggatgaccaccgaggacatgctcagcgtctggaaccgggtgtggatcgaggagaacccgtggatggaggacaagacgcacgtgtccagctgggaggaggtcccctacctgggcaagcgcgaggaccagtggtgcgggtccctgatcggcctcaccgcccgggccacctgggcgaccaacatccaggtggccatcaaccaggtgcgccgcctgatcgggaacgagaactacctggactacatgacgagcatgaagcggttcaagaacgagtccgaccccgagggcgccctctggtga

SEQ ID NO: 8843 - RNA, 9879 nt, synthetic construct
  misc_feature 1..9879: note = derived and/or modified CDS sequence (opt1) from DENV-1__KC759167__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgcgacaagcggagcgtggccctcgcgccccacgtgggcctggggctggagacgcggaccgagacctggatgagctccgagggcgcctggaagcagatccagcgggtcgagacctgggccctccgccacccggggttcacggtgatcgccctgttcctggcgcacgccatcggcaccagcgtgacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcgatcctgcggaagctctgcatcgaggccaagatctccaacaccaccacggacagccgctgcccgacccagggcgaggcccccgaggtggaggagcaggacgccaacttcgtctgccggcgcaccttcgtggaccggggctgggggaacggctgcgggctgttcggcaaggggtccctgatcacgtgcgccaagttcaagtgcgtgacgaagctcgagggcaagatcgtccagtacgagaacctgaagtacagcgtgatcgtgaccgtccacaccggcgaccagcaccaggtggggaacgagtccaccgagcacggcacgaccgcgaccatcacgccccaggcccccaccacggagatccagctgaccgactacggggccctcaccctggactgcagcccgcgcaccggcctggacttcaacgagatggtcctcctgacgatgaaggagaagtcctggctggtgcacaagcagtggttcctcgacctgcccctgccctggaccagcggggccagcacctcccaggagacctggaaccggcaggacctcctggtgacgttcaagaccgcccacgcgaagaagcaggaggtcgtggtgctgggcagccaggagggcgccatgcacaccgccctcaccggggccacggagatccagacctccggcaccaccacgatcttcgccgggcacctgaagtgccgcctgaagatggacaagctcaccctgaagggcatgagctacgtcatgtgcaccgggtccttcaagctggagaaggaggtggcggagacccagcacggcacggtgctcgtccagatcaagtacgagggcaccgacgccccctgcaagatcccgttcagcacccaggacgagaagggggtgacccagaacggccggctgatcacggccaaccccatcgtgaccgacaaggagaagcccgtcaacatcgaggccaagcccccgttcggggagtcctgcatcgtgatcggcgcgggcgagaaggccctgaagctgagctggttcaagaaggggtccagcatcggcaagatgttcgaggccaccgcccgcggggcccggcgcatggcgatcctcggcgacaccgcctgggacttcgggtccatcggcggcgtgttcacgagcgtcgggaagctggtgcaccagatcttcggcaccgcctacggggtgctgttctccggcgtcagctggaccatgaagatcgggatcggcgtgctcctgacctggctgggcctcaactcccgcagcacgtccctgagcatgacctgcatcgccgtggggctggtcaccctctacctgggcgtgatggtgcaggccgactccgggtgcgtcatcaactggaagggccgggagctgaagtgcgggagcggcatcttcgtgaccaacgaggtgcacacgtggaccgagcagtacaagttccaggcggacagccccaagcgcctctccgccgccatcggcaaggcctgggaggagggggtctgcggcatccggagcgccacccgcctggagaacatcatgtggaagcagatctccaacgagctgaaccacatcctcctggagaacgacatgaagttcaccgtggtggtcggggacgtggcgggcatcctggcccaggggaagaagatgatccggccccagcccatggagtacaagtacagctggaagtcctggggcaaggccaagatcatcggcgccgacgtgcagaacaccacgttcatcatcgacgggccgaacacccccgagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgccgacatgggctactggatcgagtccgagaagaacgagacctggaagctcgcgcgggccagcttcatcgaggtcaagacctgcatctggcccaagtcccacaccctgtggagcaacggcgtgctggagtccgagatgatcatcccgaagatctacgggggccccatcagccagcacaactaccgccccgggtacttcacgcagaccgccggcccgtggcacctcgggaagctggagctggacttcgacctctgcgagggcaccaccgtggtcgtggacgagcactgcggcaaccgggggccctccctgcgcacgaccaccgtgaccggcaagatcatccacgagtggtgctgccggagctgcacgccgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcgccctggcggtgttcctcctgctgatcatggggcagctcacctggaacgacctgatccgcctgtgcatcatggtcggcgccaacgccagcgaccgcatggggatgggcaccacgtacctcgccctgatggccaccttcaagatgcggcccatgttcgcggtgggcctcctgttccgcaagctgacctcccgggaggtgctgctcctgaccatcgggctgagcctcgtcgcctccgtggagctgcccaacagcctggaggagctcggcgacgggctggccatgggcatcatgatcctgaagctcctgacggacttccagtcccaccagctgtgggccaccctcctgagcctgaccttcatcaagaccacgttctccctccactacgcgtggaagaccatggccatggtcctgagcatcgtgtccctgttccccctctgcctgagcaccacctcccagaagacgacctggctgcccgtgctcctgggcagcctggggtgcaagcccctcaccatgttcctgatcgccgagaacaagatctggggccgccggtcctggcccctgaacgaggggatcatggccgtcggcatcgtgagcatcctcctgagctccctgctcaagaacgacgtgccgctggccgggcccctgatcgcgggcggcatgctcatcgcctgctacgtcatcagcgggtccagcgccgacctgtccctggagaaggccgccgaggtgagctgggaggaggaggcggagcactccggcgccagccacaacatcctcgtggaggtccaggacgacgggaccatgaagatcaaggacgaggagcgcgacgacacgctgaccatcctgctcaaggccaccctgctggccgtgtccggcgtgtaccccctcagcatccccgccaccctgttcgtctggtacttctggcggaagaagaagcagcgctccggggtgctgtgggacaccccgtccccgcccgaggtggagcgggcggtcctcgacgacggcatctaccgcatcatgcagcggggcctgctggggcgctcccaggtgggcgtgggggtcttccaggagaacgtgttccacacgatgtggcacgtgacccggggcgccgtcctgatgtaccaggggaagcgcctcgagcccagctgggcctccgtgaagaaggacctgatcagctacggcggcgggtggcggctgcagggctcctggaacaccggggagggcgtgcaggtcatcgccgtggagccggggaagaaccccaagaacgtgcagaccgcccccggcacgttcaagacccccgagggcgaggtcggggcgatcgccctcgacttcaagccgggcaccagcgggtcccccatcgtgaaccgcgagggcaagatcgtgggcctgtacgggaacggcgtcgtgaccacgagcgggacctacgtgagcgccatcgcccaggcgaaggcctcccaggagggccccctgccggagatcgaggacgaggtcttccggaagcgcaacctcaccatcatggacctgcaccccgggagcggcaagacccggcgctacctgcccgccatcgtgcgggaggccatcaagcgcaagctccgcacgctgatcctggcccccacccgggtggtcgcgtccgagatggccgaggccctcaagggcatgccgatccgctaccagaccaccgccgtcaagagcgagtacacggggaaggagatcgtggacctgatgtgccacgccaccttcaccatgcggctgctctcccccgtccgcgtgcccaactacaacatgatcatcatggacgaggcgcacttcaccgaccccagctccatcgccgcccggggctacatcagcacgcgcgtggggatgggcgaggccgccgcgatcttcatgaccgccaccccgcccgggtccgtcgaggccttcccccagagcaacgccgtgatccaggacgaggagcgggacatccccgagcgctcctggaacagcggctacgagtggatcaccgacttcccgggcaagacggtgtggttcgtcccctccatcaagagcgggaacgacatcgcgaactgcctgcggaagaacggcaagcgcgtgatccagctgtcccggaagaccttcgacaccgagtaccagaagaccaagaacaacgactgggactacgtggtcacgaccgacatcagcgagatgggggccaacttccgcgccgaccgggtgatcgacccccgccggtgcctcaagcccgtgatcctgaaggacggcccggagcgcgtcatcctggccgggcccatgcccgtgaccgtcgcctccgcggcccagcggcgcggccggatcggccgcaaccacaacaaggagggggaccagtacatctacatgggccagcccctcaacaacgacgaggaccacgcccactggaccgaggccaagatgctgctggacaacatcaacacgccggaggggatcatccccgccctcttcgagcccgagcgcgagaagtccgcggccatcgacggcgagtaccggctgcgcggggaggcccggaagacctacgtggagctgatgcgccggggcgacctccccgtgtggctgtcctacaaggtcgccagcgagggcttccagtacagcgaccgccggtggtacttcgacggggagcgcaacaaccaggtgctggaggagaacatggacgtggagatctggaccaaggagggcgagcggaagaagctccgcccgcggtggctggacgcccgcacctactccgaccccctggcgctccgggagttcaaggagttcgccgccgggcgccggagcgtctccggcgacctgatcctggagatcggcaagctcccccagcacctgacgcagcgcgcccagaacgcgctggacaacctcgtgatgctgcacaacagcgagcagggcgggcgggcctaccgccacgccatggaggagctgcccgacaccatcgagaccctcatgctgctggccctcatcgccgtgctgaccgggggcgtcacgctgttcttcctctccgggcggggcctgggcaagaccagcatcgggctgctctgcgtgatggcgtccagcgtgctgctgtggatggcctccgtcgagccgcactggatcgccgccagcatcatcctcgagttcttcctgatggtgctgctcatccccgagcccgaccgccagcggaccccgcaggacaaccagctggcctacgtggtcatcggcctcctgttcatgatcctgaccgtggcggccaacgagatggggctgctcgagaccacgaagaaggacctgggcatcgggcacgtggccgtcggcaaccaccaccacgccgccatgctggacgtggacctccaccccgcgtccgcctggaccctgtacgccgtggccaccaccatcatcacgcccatgatgcgccacaccatcgagaacaccaccgccaacatcagcctgacggcgatcgccaaccaggccgccatcctcatgggcctggacaaggggtggcccatctccaagatggacatcggcgtcccgctgctcgcgctggggtgctacagccaggtgaaccccctgaccctcaccgccgccgtgctgatgctggtcgcccactacgccatcatcggccccgggctccaggcgaaggccacccgcgaggcccagaagcggacggccgccggcatcatgaagaaccccaccgtggacggcatcgtggcgatcgacctggacccggtcgtgtacgacgccaagttcgagaagcagctggggcagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggcgaacatcttccggggctcctacctcgccggggccggcctggccttcagcctgatgaagtccctcgggggcgggcgccggggcaccggcgcgcagggggagacgctgggcgagaagtggaagcgccagctgaaccagctctccaagctggagttcaacagctacaagcggtccgggatcatggaggtcgaccgcagcgaggccaaggagggcctgaagcgcggggagaccaccaagcacgccgtgtcccgcggcaccgccaagctccggtggttcgtggagcgcaacctggtcaagcccgagggcaaggtgatcgacctggggtgcggccgcggcgggtggagctactactgcgccgggctgaagaaggtgacggaggtcaaggggtacaccaagggcgggccgggccacgaggagcccatccccatggcgacctacgggtggaacctcgtgaagctgcactccggcaaggacgtgttcttcatcccgcccgagaagtgcgacaccctgctctgcgacatcggggagagctcccccaaccccacgatcgaggagggccgcaccctgcgggtcctgaagatggtggagccctggctccgcggcaaccagttctgcatcaagatcctgaacccctacatgcccagcgtggtcgagaccctggagcagatgcagcggaagcacgggggcatgctcgtgcgcaaccccctgtcccggaacagcacccacgagatgtactgggtgtcctgcgggacgggcaacatcgtcagcgccgtgaacatgacctcccgcatgctgctcaaccgcttcaccatggcccaccggaagcccacctacgagcgcgacgtggacctgggcgccgggacccggcacgtcgccgtggagccggaggtggcgaacctggacatcatcggccagcgcatcgagaacatcaagcacgagcacaagagcacgtggcactacgacgaggacaacccctacaagacctgggcctaccacgggtcctacgaggtcaagcccagcggctccagcagctccatggtgaacggggtcgtgaagctcctgaccaagccctgggacgtgatcccgatggtcacccagatcgccatgacggacaccacccccttcggccagcagcgggtgttcaaggagaaggtggacacccgcacgcccaaggccaagcggggcaccgcccagatcatggaggtcaccgcgaagtggctgtgggggttcctcagccgcaacaagaagccgcggatctgcacccgcgaggagttcacgcggaaggtgcgctccaacgccgccatcggcgccgtgttcgtcgacgagaaccagtggaacagcgcgaaggaggccgtggaggacgagcggttctgggacctggtgcaccgcgagcgggagctgcacaagcaggggaagtgcgcgacctgcgtctacaacatgatgggcaagcgcgagaagaagctcggggagttcggcaaggccaagggctcccgggccatctggtacatgtggctgggggcgcgcttcctggagttcgaggccctcggcttcatgaacgaggaccactggttcagccgggagaactccctgagcggggtggagggcgaggggctgcacaagctcggctacatcctgcgcgacatctccaagatccccggcgggaacatgtacgccgacgacaccgccggctgggacacccggatcacggaggacgacctgcagaacgaggcccgcatcaccgacatcatggagcccgagcacgcgctcctggccaagagcatcttcaagctgacctaccagaacaaggtggtccgcgtgcagcggcccgccaagaacgggaccgtgatggacgtcatctcccgccgggaccagcgcggcagcggccaggtggggacgtacggcctcaacaccttcaccaacatggaggcccagctgatccggcagatggagtccgaggagatcttcagcccgtccgagctggagacccccaacctcgccgagcgcgtgctggactggctggagaagtacgggatcgagcggctcaagcgcatggcgatcagcggcgacgactgcgtcgtgaagcccatcgacaaccggttcgccacggccctgaccgccctgaacgacatggggaaggtgcgcaaggacatcccccagtgggagccgtccaagggctggaacgactggcagcaggtccccctctgcagccaccacttccaccagctgatcatgaaggacggccgggagatcgtggtgccctgccgcaaccaggacgagctggtcgggcgggcccgcgtgagccagggcgcggggtggtccctccgggagaccgcctgcctgggcaagagctacgcccagatgtggcagctgatgtacttccaccgccgggacctccgcctggccgcgaacgccatctgctccgccgtgcccgtcgactggatcccgaccagccggacgacctggtccatccacgcccaccaccagtggatgaccaccgaggacatgctgagcgtgtggaaccgcgtgtggatcgaggagaacccctggatggaggacaagacgcacatctccagctggggcgacgtcccctacctcggcaagcgcgaggaccagtggtgcggctccctgatcgggctgaccgcccgggcgacctgggccaccaacatccaggtggccatcaaccaggtgcgccggctcatcggcaacgagaactacctggactacatgacgagcatgaagcgcttcaagaacgagtccgaccccgagggggccctgtggtga

SEQ ID NO: 8844 - RNA, 9879 nt, synthetic construct
  misc_feature 1..9879: note = derived and/or modified CDS sequence (opt1) from DENV-1__JQ048541__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgcgacaagcggagcgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcctgacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctcaagctgtcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctcgtgcaccagatcttcggcaccgcctacggggtgctgttcagcggcgtctcctggaccatgaagatcgggatcggcgtgctgctcacgtggctgggcctgaacagccgctccaccagcctctccatgacctgcatcgccgtggggctggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggcggacagcccgaagcgcctgagcgccgccatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgtggcgggcatcctggcccaggggaagaagatgatccggccccagcccatggagcacaagtactcctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacacgctctggtccaacggcgtgctggagagcgagatgatcatccccaagatctacgggggcccgatctcccagcacaagctgcgccccgggtacttcacccagaccgccggcccctggcacctcgggaagctggagctggacttcgacctctgcgagggcaccacggtggtcgtggacgagcactgcggcaaccgggggccgagcctgcgcaccaccaccgtgacgggcaagatcatccacgagtggtgctgccggtcctgcaccctgccgcccctgcgcttccgcggggaggacggctgctggtacgggatggagatccgccccgtcaaggagaaggaggagaacctggtcaagagcatggtgtccgccggcagcggcgaggtcgacagcttctccctggggctcctgtgcatcagcatcatgatcgaggaggtgatgcggtcccgctggagccggaagatgctgatgaccggcaccctcgccgtgttcttcctgctgatcatggggcagctcacgtggaacgacctgatccgctcctgcatcatggtcggcgcgaacgccagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcgtccgtggagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtcctcagcatcgtgtccctgttccccctgtgcctcagcacgacctcccagaagaccacctggctgcccgtgctgctcggcagcctggggtgcaagccgctgacgatgttcctcatcgccgagaacaagatctggggccggaagtcctggcccctgaacgaggggatcatggccgtcggcatcgtgagcatcctgctcagctccctgctgaagaacgacgtgcccctcgccgggcccctgatcgccggcggcatgctgatcgcgtgctacgtcatcagcgggtccagcgccgacctctccctggagaaggccgccgaggtgagctgggaggaggaggccgagcactccggcgcgagccacaacatcctggtggaggtccaggacgacgggaccatgaagatcaaggacgaggagcgcgacgacaccctcaccatcctgctgaaggccaccctcctggccgtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacccgcggcgcggtcctgatgtaccaggggaagcggctggagcccagctgggcctccgtgaagaaggacctcatcagctacggcggcgggtggcgcctgcagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctctacggcaacggggtcgtgaccaccagcggcacctacgtgagcgccatcgcccaggccaaggcgtcccaggaggggccgctgcccgagatcgaggacgaggtcttccgcaagcggaacctgacgatcatggacctccaccccggcagcgggaagacccgccggtacctgccggccatcgtgcgcgaggccatcaagcggaagctgcgcaccctcatcctggcccccacccgcgtggtcgcctccgagatggcggaggccctgaagggcatgcccatccggtaccagacgaccgccgtcaagagcgagcacaccggcaaggagatcgtggacctcatgtgccacgccaccttcacgatgcgcctgctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctcaaggacgggcccgagcgggtcatcctggccggccccatgccggtgacggtcgcctccgccgcgcagcgccgggggcgcatcggccggaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggacgaaggagggggagcgcaagaagctgcggccccgctggctcgacgcccggacctactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagacgctgatgctcctggccctgatcgccgtgctcaccggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcacggtggccgcgaacgagatgggcctgctggagaccaccaagaaggacctcgggatcggccacgtggccgtcgagaaccaccaccacgccaccatgctggacgtggacctgcaccccgcctccgcctggacgctctacgcggtggccaccaccatcatcaccccgatgatgcggcacacgatcgagaacaccaccgccaacatcagcctgaccgccatcgccaaccaggcggccatcctgatggggctcgacaagggctggcccatctccaagatggacatcggcgtccccctgctggccctcgggtgctacagccaggtgaaccccctgacgctgaccgccgcggtgctcatgctggtcgcccactacgccatcatcggcccggggctgcaggccaaggccacccgcgaggcgcagaagcgcaccgccgccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcggaccacctgggcgctgtgcgagagcatcacgctggccaccggccccctcaccaccctgtgggaggggtccccgggcaagttctggaacacgaccatcgccgtgagcatggccaacatcttccgcgggtcctacctggccggcgcgggcctcgccttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtcgaccggagcgaggccaaggagggcctcaagcgcggggagaccaccaagcacgcggtgtcccggggcaccgccaagctgcgctggttcgtggagcggaacctggtcaagcccgaggggaaggtgatcgacctgggctgcggccgcgggggctggagctactactgcgccgggctcaagaaggtgacggaggtcaagggctacaccaagggcggccccggccacgaggagcccatcccgatggccacctacgggtggaacctggtgaagctgtactccggcaaggacgtgttcttcatgccgcccgagaagtgcgacaccctcctgtgcgacatcggggagagctcccccaacccgacgatcgaggagggccggaccctgcgcgtcctcaagatggtggagccctggctgcgggggaaccagttctgcatcaaggtgctgaacccctacatgcccagcgtcgtggagaccctcgagcagatgcagcgcaagcacggcggcatgctggtgcggaacccgctgtcccgcaacagcacccacgagatgtactgggtctcctgcgggaccggcaacatcgtgagcgccgtgaacatgacgtcccggatgctcctgaaccgcttcaccatggcgcaccgcaagcccacctacgagcgggacgtcgacctgggggccggcacccgccacgtggccgtggagcccgaggtcgccaacctcgacatcatcggccagcggatcgagaacatcaagcacgagcacaagagcacgtggcactacgacgaggacaacccctacaagacctgggcctaccacgggtcctacgaggtgaagccgagcggctccgcgagcagcatggtcaacggggtggtgaagctgctgaccaagccctgggacgtcatccccatggtgacccagatcgccatgacggacaccacccccttcggccagcagcgcgtgttcaaggagaaggtcgacacccggacgccgaaggccaagcgcgggaccgcccagatcatggaggtgaccgcccggtggctctggggcttcctgtcccgcaacaagaagccccggatctgcacccgcgaggagttcacgcggaaggtgcgcagcaacgcggccatcggcgccgtcttcatcgacgagaaccagtggaactccgccaaggaggcggtggaggacgagcggttctgggacctggtgcaccgcgagcgggagctccacaagcaggggaagtgcgcgacctgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcacggaggacgacctccagaacgaggccaagatcaccgacatcatggagccggagcacgccctgctggcgaaggccatcttcaagctcacctaccagaacaaggtggtccgcgtgcagcgccccgccaagaacgggaccgtgatggacgtcatctcccggcgcgaccagcggggcagcggccaggtggggacgtacggcctgaacaccttcaccaacatggaggcccagctgatccgccagatggagtccgaggggatcttcagcccctccgagctcgagacccccaacctggccgagcgggtgctggactggctcgagaagtacggcgtcgagcgcctgaagcggatggcgatcagcggggacgactgcgtggtgaagccgatcgacgaccgcttcgccacggccctgaccgccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggcgggctgggggctccgcgagaccgcctgcctgggcaagagctacgcccagatgtggcagctgatgtacttccaccggcgcgacctccggctggccgcgaacgccatctgcagcgccgtccccgtggactgggtgcccacctcccgcacgacctggagcatccacgcccaccaccagtggatgaccaccgaggacatgctgtccgtctggaaccgggtgtggatcgaggagaacccctggatggaggacaagacgcacatcagctcctgggaggacgtgccgtacctcgggaagcgcgaggaccagtggtgcggcagcctgatcggcctgaccgcccgcgcgacctgggccaccaacatccaggtcgccatcaaccaggtgcggcgcctcatcgggaacgagaactacctggactacatgacctccatgaagcggttcaagaacgagagcgaccccgagggcgccctgtggtga

SEQ ID NO: 8845 - RNA, 9879 nt, synthetic construct
  misc_feature 1..9879: note = derived and/or modified CDS sequence (opt1) from DENV-1__JN697056__SS-prME
  source 1..9879: mol_type = other RNA
agcgtgaccatgctgctcatgctgctgcccaccgccctcaccttccacctgaccacccggggcggggagccccacatgatcgtgagcaagcaggagcggggcaagagcctcctcttcaagaccagcgccggggtgaacatgtgcaccctgatcgcgatggacctgggcgagctctgcgacgacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctggcgccccacatcggcctggggctcgagacccgcaccgagacgtggatgagcagcgagggcgcctggcggcagatccagaaggtggagacctgggcgctgcgccaccccgggttcaccgtgatcgccctgttcctcgcccacgccatcggcaccagcatcacgcagaaggggatcatcttcatcctgctgatgctcgtgaccccctccatggcgatgcggtgcgtgggcatcggcaaccgcgacttcgtggaggggctgagcggcgccacctgggtggacgtggtcctggagcacgggtcctgcgtgaccacgatggccaaggacaagcccaccctcgacatcgagctgctgaagaccgaggtgaccaaccccgccgtcctccggaagctgtgcatcgaggccaagatcagcaacacgaccaccgactcccgctgcccgacccagggcgaggcgacgctggtggaggagcaggacaccaacttcgtgtgccggcgcaccttcgtcgaccggggctgggggaacggctgcggcctcttcggcaaggggagcctgatcacgtgcgccaagttcaagtgcgtgacgaagctggagggcaagatcgtgcagtacgagaacctcaagtactccgtcatcgtgaccgtgcacaccggcgaccagcaccaggtcgggaacgagaccaccgagcacggcacgatcgccaccatcacgccccaggcccccaccagcgagatccagctgacggactacggggccctgaccctcgactgcagcccccggaccggcctggacttcaacgagatggtgctgctcaccatgaaggagaagtcctggctggtccacaagcagtggttcctggacctccccctgccctggacgtccggggcgagcaccagccaggagacctggaaccggcaggacctgctcgtgaccttcaagacggcccacgccaagaagcaggaggtggtcgtgctgggctcccaggagggcgccatgcacaccgccctgaccggggcgaccgagatccagacgagcggcaccaccaccatcttcgccgggcacctcaagtgccgcctgaagatggacaagctgacgctcaagggcatctcctacgtgatgtgcaccgggcccttcaagctggagaaggaggtcgccgagacccagcacggcaccgtgctggtgcaggtcaagtacgagggcacggacgccccctgcaagatcccgttcagctcccaggacgagaagggggtgacccagaacggccggctggtgaccgccaaccccatcgtcaccgacaaggagaagcccgtgaacatcgaggcggagcccccgttcggggagagctacatcgtggtcggcgccggcgagaaggccctcaagctgtcctggttcaagaaggggagctccatcggcaagatgttcgaggccacggcgcgcggggcccggcgcatggccatcctgggcgacaccgcctgggacttcgggagcatcggcggcgtgttcacctccgtggggaagctcgtccaccagatcttcggcaccgcctacggggtgctgttcagcggcgtgtcctggacgatgaagatcgggatcggcatcctgctcacctggctgggcctgaacagccgctccaccagcctctccatgacctgcatcgcggtcgggatgatcacgctgtacctgggcgtgatggtgcaggccgacagcgggtgcgtcatcaactggaagggccgggagctcaagtgcgggtccggcatcttcgtgaccaacgaggtgcacacctggaccgagcagtacaagttccaggccgacagccccaagcgcctgagcgccgccatcggcaaggcgtgggaggagggggtctgcggcatccggtccgccacccgcctggagaacatcatgtggaagcagatcagcaacgagctcaaccacatcctgctggagaacgacatgaagttcacggtggtggtcggggacgtgtccggcatcctcgcccaggggaagaagtccatccggccccagcccatggagcacaagtactcctggaagtcctggggcaaggccaagatcatcggcgccgacgtgcagaacaccaccttcatcatcgacgggccgaacacccccgagtgccccgacgaccagcgcgcgtggaacatctgggaggtcgaggactacggcttcgggatcttcacgaccaacatctggctgaagctgcgggactcctacacccaggtgtgcgaccaccgcctcatgagcgccgccatcaaggactccaaggccgtgcacgcggacatgggctactggatcgagagcgagaagaacgagacctggaagctggcccgggcctccttcatcgaggtcaagacgtgcatctggcccaagagccacaccctgtggtccaacggcgtgctcgagagcgagatgatcatcccgaagatctacgggggccccatctcccagcacaactaccgccccgggtacttcacccagaccgccggcccgtggcacctggggaagctggagctcgacttcgacctgtgcgagggcacgaccgtggtcgtggacgagcactgcggcaaccgggggcccagcctgcgcaccaccacggtgaccggcaagatcatccacgagtggtgctgccggtcctgcaccctgccgcccctgcgcttcaagggggaggacggctgctggtacgggatggagatccggccggtcaaggagaaggaggagaacctggtcaagagcatggtgagcgccggctccggcgaggtcgacagcttctccctcgggctgctgtgcatcagcatcatgatcgaggaggtgatgcgctcccggtggagcaagaagatgctcatgaccggcacgctggcggtgttcctgctcctgaccatggggcagctgacctggaacgacctcatccgcctgtgcatcatggtcggcgccaacgcctccgacaacatggggatgggcaccacgtacctggccctcatggccaccttccggatgcgccccatgttcgccgtggggctgctgttccgccggctcaccagccgcgaggtgctgctgctcaccgtcgggctgtccctggtggccagcgtcgagctccccaactccctggaggagctgggcgacgggctcgccatgggcatcatgatcctgaagctgctcacggacttccagagccaccagctgtgggccaccctgctctccctgaccttcgtgaagaccacgttcagcctgcactacgcctggaagaccatggcgatgatcctctccatcgtgagcctgctgcccctctgcctgtccaccaccagccagaagacgacctggctgccggtcctcctgggctccctggggtgcaagcccctcaccatgttcctgatcaccgagaacaagatctggggccgcaagagctggcccctgaacgaggggatcatggccgtgggcatcgtgagcatcctcctgtccagcctgctcaagaacgacgtccccctggccgggccgctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgagatccaggacgacgggaccatgaagatcaaggacgaggagcgcgacgacacgatcaccatcctgctgaaggccaccctcctggccatcagcggcgtgtaccccatgtccatccccgccaccctgttcgtgtggtacttctggcagaagcggaagcagcgcagcggggtcctctgggacacgccctccccgcccgaggtggagcgggccgtgctggacgacggcatctaccgcatcctgcagcggggcctgctcgggcgcagccaggtcggcgtgggggtgttccaggagggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaacccgaagaacgtgcagacggcccccggcaccttcaagacctccgagggcgaggtgggggccatcgcgctggacttcaagcccggcaccagcgggagccccatcgtcaaccgcgagggcaagatcgtgggcctgtacgggaacggcgtggtcacgacctccgggacctacgtgagcgccatcgcccaggccaaggcctcccaggagggcccgctccccgagatcgaggacgaggtgttccggaagcgcaacctgaccatcatggacctgcaccccgggagcggcaagacgcggcgctacctcccggcgatcgtccgggaggccatcaagcgcaagctgcggaccctggtgctcgcccccacccgcgtggtcgcctccgagatggcggaggccctgaagggcatgcccatccgctaccagaccacggccgtcaagagcgagcacaccgggcgggagatcgtggacctgatgtgccacgccaccttcaccatgcgcctcctgtcccccgtccgggtgccgaactacaacatgatcatcatggacgaggcccacttcacggaccccgcgagcatcgccgcccgcggctacatctccacccgggtggggatgggcgaggccgccgcgatcttcatgaccgccacgccgcccgggagcgtcgaggccttcccgcagtccaacgccgtgatcctggacgaggagaaggacatccccgagcgcagctggaactccggctacgactggatcacggacttccccggcaagaccgtgtggttcgtccccagcatcaagtccgggaacgacatcgccaactgcctccggaagaacggcaagcgcgtgatccagctgagccggaagaccttcgacaccgagtaccagaagacgaagaacaacgactgggactacgtggtcaccaccgacatctccgagatgggggcgaacttccgcgccgaccgggtgatcgacccgcgccggtgcctgaagcccgtgatcctcaaggacggccccgagcgcgtcatcctggccgggcccatgccggtgaccgtcgccagcgcggcccagcggcgcggccggatcggccgcaaccagaacaaggagggggaccagtacatctacatgggccagcccctgaacaacgacgaggaccacgcccactggacggaggccaagatgctcctggacaacatcaacacccccgaggggatcatccccgccctgttcgagccggagcgggagaagtccgcggccatcgacggcgagtaccgcctccgcggggaggcccggaagaccttcgtggagctgatgcgccggggcgacctgcccgtgtggctcagctacaaggtcgccagcgagggcttccagtactccgaccgccggtggtgcttcgacggggagcgcaacaaccaggtgctggaggagaacatggacgtggagatctggaccaaggagggcgagcggaagaagctgcgcccccggtggctcgacgcccgcacgtacagcgaccccctggcgctgcgggagttcaaggagttcgccgccgggcgccggtccgtcagcggcgacctcatcctggagatcggcaagctgccgcagcacctcacccagcgcgcccagaacgccctggacaacctggtgatgctccacaactccgagcagggcgggaaggcgtaccggcacgccatggaggagctgcccgacaccatcgagaccctgatgctcctggccctgatcgccgtgctcaccgggggcgtcacgctgttcttcctgagcgggcgcggcctcggcaagacctccatcgggctgctgtgcgtgatgagctccagcgcgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgcggccaacgagatggggctgctggagacgaccaagaaggacctcggcatcgggcacgccgccgccgagaaccaccaccacgcggccatgctggacgtggacctgcaccccgcctccgcctggaccctctacgccgtggcgaccacgatcatcaccccgatgatgcggcacaccatcgagaacaccacggccaacatcagcctgaccgccatcgccaaccaggccgcgatcctgatgggcctcgacaagggctggcccatctccaagatggacatcggggtccccctgctggccctcggctgctacagccaggtgaaccccctgaccctgaccgccgccgtgctcatgctggtcgcgcactacgccatcatcgggccgggcctgcaggccaaggccacgcgcgaggcccagaagcggaccgcggccgggatcatgaagaaccccaccgtggacggcatcgtggccatcgacctcgaccccgtcgtgtacgacgccaagttcgagaagcagctgggccagatcatgctgctcatcctgtgcacctcccagatcctgctcatgcgcacgacctgggccctgtgcgagagcatcaccctggcgaccgggcccctcacgaccctgtgggagggctccccggggaagttctggaacaccaccatcgccgtgagcatggccaacatcttccgcggcagctacctggccggcgccgggctcgcgttctccctgatgaagtccctgggcgggggccggcgcgggacgggcgcccagggcgagaccctcggggagaagtggaagcggcagctgaaccagctgtccaagagcgagttcaacatctacaagcgctccggcatcgtcgaggtggaccggagcgaggccaaggaggggctcaagcgcggcgagaccaccaagcacgccgtgtcccgggggacggcgaagctgcgctggttcgtcgagcggaacctggtgaagcccgagggcaaggtgatcgacctgggctgcgggcgcggcgggtggagctactactgcgccggcctcaagaaggtcaccgaggtgaaggggtacaccaagggcggccccgggcacgaggagcccatcccgatggccacctacggctggaacctggtgaagctgtactccgggaaggacgtcttcttcatcccgcccgagaagtgcgacacgctcctgtgcgacatcggcgagagctcccccaacccgaccatcgaggaggggcggaccctgcgcgtgctcaagatggtggagccctggctgcggggcaaccagttctgcatcaagatcctgaacccctacatgcccagcgtcgtggagaccctcgagcagatgcagcgcaagcacggcgggatgctggtgcggaacccgctgtcccgcaacagcacccacgagatgtactgggtctcctgcggcacggggaacatcgtgagcgccgtgaacatgacctcccggatgctcctgaaccgcttcaccatggcccaccggaagcccacctacgagcgcgacgtcgacctgggcgcgggcacgcgccacgtggccgtggagcccgaggtcgccaacctcgacatcatcgggcagcggatcgagaacatcaagaacgagcacaagagcacctggcactacgacgaggacaacccctacaagacctgggcctaccacggctcctacgaggtgaagccgagcgggagcgcctccagcatggtgaacggcgtcgtgcgcctgctgaccaagccctgggacgtcatccccatggtgacgcagatcgcgatgaccgacaccacccccttcgggcagcagcgggtgttcaaggagaaggtcgacacgcgcaccccgaaggccaagcggggcaccgcccagatcatggaggtgaccgccaagtggctctggggcttcctgtcccgcaacaagaagccccggatctgcacgcgcgaggagttcacccggaaggtgcgcagcaacgccgcgatcggggccgtcttcgtggacgagaaccagtggaactccgccaaggaggccgtggaggacgagcggttctgggacctggtccgccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgcggacgacaccgccgggtgggacacgcgcatcaccgaggacgacctccagaacgaggccaagatcaccgacatcatggagccggagcacgccctgctggccacctccatcttcaagctcacgtaccagaacaaggtcgtgcgggtgcagcgccccgcgaagaacggcaccgtcatggacgtgatcagccgccgggaccagcgcgggtccggccaggtgggcacctacgggctgaacaccttcacgaacatgggcgcccagctgatccggcagatggagagcgaggggatcttcctcccctccgagctggagacccccaacctggccggccgcgtcctcgactggctggagaagcacgggatcgagcggctgcgccggatggccatcagcggcgacgactgcgtggtgaagccgatcgacgaccgcttcgccaccgcgctcaccgccctgaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctcgtggggcgcgcccgggtgagccagggcgccgggtggtccctgcgcgagacggcctgcctgggcaagagctacgcgcagatgtggcagctcatgtacttccaccggcgcgacctgcggctggccgccaacgccatctgctccgcggtccccgtggactgggtgcccaccagccgcaccacctggtccatccacgcccaccaccagtggatgacgaccgaggacatgctcagcgtctggaaccgggtgtggatcgaggagaacccctggatggaggacaagacccacgtgtccagctgggaggacgtcccgtacctgggcaagcgcgaggaccagtggtgcgggtccctgatcggcctcaccgcccgcgccacctgggccacgaacatccaggtggcgatcaaccaggtgcggcgcctgatcgggaacgagaactacctggactacatgaccagcatgaagcggttcaagaacgagtccgaccccgagggcgccctctggtga

SEQ ID NO: 8846 - RNA, 9879 nt, synthetic construct
  misc_feature 1..9879: note = derived and/or modified CDS sequence (opt1) from DENV-1__JN697057__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatctgcaccctcatcgccatggacctgggcgagctgtgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaaggtgagctggttcaagaaggggtccagcatcggcaagatgttcgaggccaccgcccgcggggcccggcgcatggcgatcctcggcgacacggcctgggacttcgggtccatcggcggcgtcttcaccagcgtggggaagctggtgcaccagatcttcggcaccgcctacggggtcctgttctccggcgtgagctggaccatgaagatcgggatcggcgtgctcctgacgtggctgggcctcaactcccgcagcacctccctgagcatgacctgcatcgccgtcgggctggtgaccctctacctgggcgtgatggtccaggccgactccgggtgcgtgatcaactggaagggccgggagctgaagtgcgggagcggcatcttcgtgacgaacgaggtccacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtggtcgtgggggacgtggcgggcatcctggcccaggggaagaagatgatccggccccagcccatggagcacaagtacagctggaagtcctggggcaaggccaagatcatcggcgccgacgtccagaacacgaccttcatcatcgacgggcccaacaccccggagtgccccgacgaccagcgcgcgtggaacatctgggaggtggaggactacggcttcgggatcttcaccacgaacatctggctcaagctgcgggacagctacacccaggtgtgcgaccaccgcctgatgtccgccgccatcaaggacagcaaggccgtccacgccgacatgggctactggatcgagtccgagaagaacgagacctggaagctcgcgcgggccagcttcatcgaggtgaagacctgcatctggcccaagtcccacacgctgtggagcaacggcgtgctggagtccgagatgatcatccccaagatctacgggggcccgatcagccagcacaactaccgccccgggtacttcacccagaccgccggcccctggcacctcgggaagctggagctggacttcgacctctgcgagggcaccacggtcgtggtggacgagcactgcggcaaccgggggccgtccctgcgcaccaccaccgtcacgggcaagatcatccacgagtggtgctgccggagctgcaccctgccgcccctgcgcttccgcggggaggacggctgctggtacgggatggagatccgccccgtgaaggagaaggaggagaacctggtgaagtccatggtcagcgccggcagcggcgaggtggactccttcagcctggggctcctgtgcatctccatcatgatcgaggaggtgatgcggagccgctggtcccggaagatgctgatgaccggcaccctcgccgtcttcttcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtgggcctcctgttccgccggctgacgtcccgcgaggtcctgctcctgaccatcgggctgagcctcgtggcgtccgtcgagctgcccaacagcctggaggagctcggcgacgggctggccatgggcatcatgatcctgaagctcctgaccgacttccagtcccaccagctgtgggtgaccctcctgagcctgacgttcatcaagaccgccttctccctccactacgcctggaagaccatggcgatggtgctgagcatcgtctccctgttccccctctgcctgagcaccacgtcccagaagaccacctggctgcccgtgctcctgggcagcctggggtgcaagccgctcaccatgttcctgatcgccgagaacaagatctggggccggaagtcctggcccctgaacgaggggatcatggccgtgggcatcgtcagcatcctcctgagctccctgctcaagaacgacgtgcccctggccgggcccctgatcgccggcggcatgctcatcgcgtgctacgtgatcagcgggtccagcgccgacctgtccctggagaaggccgccgaggtcagctgggaggaggaggccgagcactccggcgcgagccacaacatcctcgtggaggtgcaggacgacgggacgatgaagatcaaggacgaggagcgcgacgacaccctgaccatcctgctcaaggccaccctgctggccgtctccggcgtgtacccgctcagcatccccgccaccctgttcgtgtggtacttctggcagaagaagaagcagcggtccggggtcctgtgggacacgcccagcccgcccgaggtggagcgcgccgtgctcgacgacggcatctaccggatcatgcagcgcggcctgctggggcggtcccaggtcggcgtgggggtgttccaggagaacgtcttccacaccatgtggcacgtgacccgcggcgcggtgctgatgtaccaggggaagcggctcgagcccagctgggcctccgtcaagaaggacctgatcagctacggcggcgggtggcgcctgcagggctcctggaacaccggggaggaggtccaggtgatcgccgtcgagcccggcaagaaccccaagaacgtgcagacggcccccgggaccttcaagacccccgagggcgaggtgggcgccatcgcgctcgacttcaagcccgggaccagcggctcccccatcgtcaaccgggagcgcaagatcgtggggctgtacggcaacggcgtggtcacgaccagcgggacctacgtgagcgccatcgcccaggccaaggcgtcccaggagggcccgctgcccgagatcgaggacgaggtgttccggaagcgcaacctcaccatcatggacctgcaccccgggagcggcaagacgcggcgctacctgccggccatcgtccgggaggccatcaagcgcaagctccgcaccctgatcctggcccccacccgggtggtggcctccgagatggcggaggccctcaaggggatgcccatccgctaccagaccacggccgtcaagagcgagcacaccggcaaggagatcgtggacctgatgtgccacgccaccttcaccatgcggctgctctcccccgtgcgcgtcccgaactacaacatgatcatcatggacgaggcccacttcacggaccccagctccatcgcggcccggggctacatcagcacccgcgtggggatgggcgaggccgccgccatcttcatgaccgcgacgccgcccgggtccgtggaggccttcccgcagagcaacgccgtcatccaggacgaggagcgggacatccccgagcgctcctggaacagcggctacgagtggatcacggacttccccgggaagaccgtgtggttcgtgccctccatcaagagcggcaacgacatcgccaactgcctgcggaagaacggcaagcgcgtcatccagctgtcccggaagaccttcgacaccgagtaccagaagacgaagaacaacgactgggactacgtggtgaccaccgacatcagcgagatgggggcgaacttccgcgccgaccgggtcatcgacccgcgccggtgcctcaagcccgtgatcctgaaggacggccccgagcgcgtcatcctggccgggcccatgccggtgaccgtggcctccgccgcgcagcggcgcggccggatcgggcgcaaccacaacaaggagggcgaccagtacatctacatgggccagcccctcaacaacgacgaggaccacgcccactggacggaggccaagatgctgctggacaacatcaacacccccgaggggatcatccccgccctcttcgagccggagcgcgagaagtccgccgcgatcgacggcgagtaccggctgcgcggggaggcccggaagaccttcgtcgagctgatgcgccggggcgacctccccgtgtggctgtcctacaaggtggccagcgaggggttccagtacagcgaccgccggtggtgcttcgacggcgagcgcaacaaccaggtcctggaggagaacatggacgtggagatctggaccaaggagggcgagcggaagaagctccgcccccggtggctggacgcccgcacgtactccgaccccctggccctccgggagttcaaggagttcgcggccgggcgccggagcgtgtccggcgacctgatcctggagatcgggaagctcccgcagcacctgacccagcgcgcccagaacgccctggacaacctcgtcatgctgcacaacagcgagcagggcggccgggcgtaccgccacgccatggaggagctgcccgacaccatcgagaccctcatgctgctggccctcatcgccgtgctgaccgggggcgtgaccctgttcttcctctccgggcggggcctggggaagaccagcatcggcctgctctgcgtcatggcctccagcgtgctgctgtggatggcgtccgtggagccccactggatcgccgccagcatcatcctcgagttcttcctgatggtcctgctcatccccgagccggaccgccagcggacgccccaggacaaccagctggcctacgtggtgatcggcctcctcttcatgatcctgaccgtcgccgcgaacgagatggggctgctcgagacgaccaagaaggacctgggcatcgggcacgtggccgtggagaaccaccaccacgccgccatgctggacgtcgacctccaccccgcctccgcgtggaccctgtacgccgtggccaccacgatcatcaccccgatgatgcgccacaccatcgagaacaccacggccaacatcagcctgaccgccatcgcgaaccaggccgccatcctcatgggcctggacaaggggtggcccatctccaagatggacatcggcgtgcccctgctcgccctgggctgctacagccaggtcaaccccctgaccctcaccgcggccgtgctgatgctggccgcccactacgccatcatcgggccgggcctccaggcgaaggccacgcgcgaggcccagaagcggaccgccgccgggatcatgaagaaccccaccgtggacggcatcgtcgcgatcgacctggaccccgtggtgtacgacgccaagttcgagaagcagctggggcagatcatgctcctgatcctgtgcacctcccagatcctcctgatgcgcacgacctgggccctgtgcgagagcatcaccctcgccaccggccccctgacgaccctgtgggagggctccccggggaagttctggaacaccaccatcgccgtcagcatggcgaacatcttccggggctcctacctcgccggggccggcctggccttcagcctgatgaagtccctcggcgggggccgccgggggacgggcgcgcagggggagaccctgggcgagaagtggaagcgccagctgaaccagctctccaagagcgagttcaacacctacaagcggtccggcatcatggaggtggaccgcagcgaggccaaggaggggctgaagcggggcgagaccacgaagcacgccgtgtcccgcgggaccgccaagctgcggtggttcgtcgagcgcaacctcgtgaagcccgagggcaaggtggtcgacctggggtgcggccggggcgggtggagctactactgcgccggcctgaagaaggtgaccgaggtgaaggggtacaccaagggcgggcccggccacgaggagcccatcccgatggcgacgtacggctggaacctggtcaagctccactccgggaaggacgtgttcttcatcccgcccgagaagtgcgacaccctgctgtgcgacatcggcgagagctcccccaacccgaccatcgaggaggggcgcaccctccgggtgctgaagatggtcgagccctggctgcgcggcaaccagttctgcatcaagatcctcaacccctacatgcccagcgtggtggagacgctggagcagatgcagcggaagcacgggggcatgctggtccgcaacccgctctcccggaacagcacccacgagatgtactgggtgtcctgcggcaccgggaacatcgtgagcgccgtcaacatgacctcccgcatgctgctgaaccgcttcaccatggcccaccggaagcccacgtacgagcgcgacgtggacctcggcgccgggacccggcacgtggccgtcgagcccgaggtggcgaacctggacatcatcggccagcgcatcgagaacatcaagcacgagcacaagagcacctggcactacgacgaggacaacccctacaagacctgggcctaccacggctcctacgaggtcaagccgagcgggtccgccagcagcatggtgaacggcgtggtcaagctgctcacgaagccctgggacgtgatccccatggtgacccagatcgccatgaccgacaccacgcccttcgggcagcagcgggtcttcaaggagaaggtggacacccgcaccccgaaggccaagcggggcaccgcgcagatcatggaggtgacggcccgctggctgtgggggttcctgtcccggaacaagaagccccgcatctgcacccgggaggagttcacccgcaaggtccggagcaacgccgccatcggcgcggtgttcgtggacgagaaccagtggaactccgccaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggccaagggcagccgcgcgatctggtacatgtggctcggggcccggttcctggagttcgaggccctgggcttcatgaacgaggaccactggttctcccgcgagaacagcctctccggcgtcgagggggagggcctgcacaagctggggtacatcctccgggacatcagcaagatccccggcgggaacatgtacgccgacgacacggccggctgggacacccgcatcaccgaggacgacctgcagaacgaggcgaagatcaccgacatcatggagccgaagcacgccctgctcgccaaggccatcttcaagctgacgtaccagaacaaggtggtgcgcgtccagcggcccgccaagaacggcaccgtgatggacgtgatctcccgccgggaccagcgcgggagcggccaggtcgggacctacggcctgaacaccttcacgaacatggaggcgcagctcatccggcagatggagtccgagggcatcttcagcccctccgagctggagacccccaacctggccgagcgcgtgctcgactggctggagaagtacggggtggagcggctgaagcgcatggccatcagcggcgacgactgcgtcgtgaagccgatcgacgaccggttcgccaccgccctcaccgcgctgaacgacatggggaaggtgcgcaaggacatcccccagtgggagccctccaagggctggaacgactggcagcaggtccccttctgcagccaccacttccaccagctgatcatgaaggacgggcgggagatcgtggtgccgtgccgcaaccaggacgagctcgtcggccgggcccgcgtgtcccagggcgccgggtggagcctgcgggagacggcctgcctgggcaagagctacgcgcagatgtggcagctcatgtacttccaccgccgggacctgcgcctggccgccaacgccatctgctccgccgtgcccgtcgactgggtgcccaccagccggaccacctggtccatccacgcgcaccaccagtggatgacgaccgaggacatgctcagcgtgtggaaccgcgtctggatcgaggagaacccctggatggaggacaagacccacatctccagctgggaggacgtgccgtacctggggaagcgcgaggaccagtggtgcggctccctgatcgggctcaccgcccgggccacgtgggccaccaacatccaggtggccatcaaccaggtccgccggctgatcggcaacgagaactacctggactacatgaccagcatgaagcgcttcaagaacgagtccgaccccgagggcgcgctctggtga

SEQ ID NO: 8847 - RNA, 9879 nt, synthetic construct
  misc_feature 1..9879: note = derived and/or modified CDS sequence (opt1) from DENV-1__HQ624984__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctcgcgccccacgtgggcctggggctggagacgcgcaccgagacctggatgagctccgagagcgcctggaagcagatccagcgggtggagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgcccgacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgccgctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttctccacccaggacgagaagggcgtcacgcagaacgggcggctgatcaccgccaacccgatcgtgaccgacaaggagaagcccgtgaacatcgaggccgagccgcccttcggcgagagctacatcgtcatcggggcgggcgagaaggccctgaagctctcctggttcaagaagggcagctccatcgggaagatgttcgaggccaccgcccgcggcgcccggcgcatggcgatcctgggggacacggcctgggacttcggcagcatcgggggcgtgttcacctccgtgggcaagctggtccaccagatcttcgggaccgcctacggcgtcctgttcagcggggtgtcctggaccatgaagatcggcatcggggtcctgctgacgtggctcggcctgaacagccgctccaccagcctgtccatgacctgcatcgccgtgggcctcgtgaccctgtacctgggggtcatggtgcaggccgacagcggctgcgtgatcaactggaaggggcgggagctcaagtgcggcagcgggatcttcgtcacgaacgaggtgcacacctggaccgagcagtacaagttccaggcggactccccgaagcgcctgagcgccgccatcggcaaggcctgggaggagggcgtgtgcgggatccggtccgccacccgcctggagaacatcatgtggaagcagatcagcaacgagctcaaccacatcctgctggagaacgacatgaagttcaccgtcgtggtgggcgacgtcgcggggatcctcgcccagggcaagaagatgatccggccccagcccatggagtacaagtactcctggaagtcctgggggaaggccaagatcatcggcgccgacgtgcagaacacgaccttcatcatcgacggccccaacaccccggagtgccccgacgaccagcgcgcgtggaacatctgggaggtggaggactacgggttcggcatcttcaccacgaacatctggctgaagctgcgggactcctacacccaggtctgcgaccaccgcctcatgagcgccgccatcaaggactccaaggccgtgcacgccgacatggggtactggatcgagagcgagaagaacgagacctggaagctggcgcgggcctccttcatcgaggtgaagacctgcatctggcccaagagccacacgctgtggtccaacggcgtcctcgagagcgagatgatcatccccaagatctacggcgggccgatctcccagcacaactaccgccccggctacttcacccagaccgccgggccctggcacctgggcaagctggagctcgacttcgacctgtgcgaggggaccacggtggtggtcgacgagcactgcggcaaccggggcccgagcctgcgcaccaccaccgtgacggggaagatcatccacgagtggtgctgccggtcctgcaccctgccgcccctccgcttccggggcgaggacgggtgctggtacggcatggagatccgccccgtgaaggagaaggaggagaacctggtcaagagcatggtgagcgccgggtccggcgaggtggacagcttctccctcggcctgctgtgcatcagcatcatgatcgaggaggtcatgcggtcccgctggagccggaagatgctcatgaccgggaccctggccgtgttcctgctcctgatcatgggccagctgacgtggaacgacctcatccgcctgtgcatcatggtgggggcgaacgcctccgaccgcatgggcatggggaccacctacctggccctcatggccaccttcaagatgcggccgatgttcgccgtcggcctgctgttccgccggctcacgagccgcgaggtgctgctgctcaccatcggcctgtccctggtggcgagcgtcgagctccccaactccctggaggagctgggggacggcctcgccatggggatcatgatcctgaagctgctcaccgacttccagagccaccagctgtgggccaccctgctctccctgacgttcatcaagaccaccttcagcctgcactacgcctggaagaccatggcgatggtgctctccatcgtcagcctgttccccctgtgcctctccacgaccagccagaagaccacctggctgcccgtgctgctcggctccctgggctgcaagccgctgacgatgttcctcatcgccgagaacaagatctgggggcggcgcagctggcccctgaacgagggcatcatggccgtggggatcgtcagcatcctgctctccagcctgctgaagaacgacgtgcccctcgccggccccctgatcgccgggggcatgctgatcgcgtgctacgtgatctccggcagctccgccgacctcagcctggagaaggccgccgaggtctcctgggaggaggaggccgagcacagcggggcgtcccacaacatcctggtggaggtgcaggacgacggcaccatgaagatcaaggacgaggagcgggacgacaccctcaccatcctgctgaaggccaccctcctggccgtcagcggggtgtacccgctgtccatccccgccaccctcttcgtgtggtacttctggcagaagaagaagcagcgcagcggcgtcctgtgggacacccccagcccgcccgaggtggagcgggccgtgctggacgacgggatctaccgcatcatgcagcggggcctgctcggccgcagccaggtcggggtgggcgtgttccaggagaacgtcttccacaccatgtggcacgtgacccgcggggccgtgctgatgtaccagggcaagcgcctggagccctcctgggccagcgtcaagaaggacctcatctcctacgggggcggctggcggctgcaggggagctggaacacgggcgaggaggtccaggtgatcgccgtcgagcccgggaagaaccccaagaacgtgcagaccgcccccggcaccttcaagacctccgagggggaggtgggcgccatcgcgctggacttcaagcccggcacgagcgggagccccatcgtcaaccgcgagggcaagatcgtggggctctacggcaacggcgtggtcaccacctccgggacctacgtgagcgccatcgcccaggccaaggcgtcccaggagggccccctgccggagatcgaggacgaggtgttccggaagcgcaacctgacgatcatggacctccaccccgggagcggcaagacccggcgctacctgcccgccatcgtccgggaggccatcaagcgcaagctgcgcaccctcatcctggccccgacccgggtggtggcctccgagatggcggaggccctgaaggggatgcccatccgctaccagacgaccgccgtcaagagcgagcacaccggcaaggagatcgtggacctcatgtgccacgccaccttcacgatgcggctgctgtcccccgtgcgcgtccccaactacaacatgatcatcatggacgaggcccacttcaccgacccgagctccatcgcggcccggggctacatcagcacccgcgtggggatgggcgaggccgccgccatcttcatgaccgcgacgccgcccgggtccgtggaggccttcccccagagcaacgccctcatccaggacgaggagcgggacatcccggagcgctcctggaacagcggctacgagtggatcaccgacttccccgggaagaccgtctggttcgtgccctccatcaagagcggcaacgacatcgccaactgcctgcggaagaacggcaagcgcgtgatccagctgtcccggaagaccttcgacacggagtaccagaagaccaagaacaacgactgggactacgtcgtgaccaccgacatcagcgagatgggggcgaacttccgcgccgaccgggtgatcgacccccgccggtgcctcaagccggtcatcctgaaggacggccccgagcgcgtgatcctggccgggcccatgcccgtgacggtcgcctccgccgcgcagcggcgcggccggatcgggcgcaaccacaacaaggagggcgaccagtacatctacatgggccagccgctcaacaacgacgaggaccacgcccactggaccgaggccaagatgctgctggacaacatcaacacccccgaggggatcatccccgccctcttcgagcccgagcgcgagaagtccgccgcgatcgacggcgagtaccggctgcgcggggaggcccggaagaccttcgtggagctgatgcgccggggcgacctcccggtctggctgagctacaaggtggcctccgaggggttccagtacagcgaccgccggtggtgcttcgacggcgagcgcaacaaccaggtgctggaggagaacatggacgtcgagatctggacgaaggagggcgagcggaagaagctccgcccccggtggctggacgcccgcacctactccgaccccctggccctccgggagttcaaggagttcgcggccgggcgccggagcgtgtccggcgacctgatcctggagatcgggaagctcccccagcacctgacccagcgcgcccagaacgccctggacaacctcgtgatgctgcacaacagcgagcagggcggccgggcgtaccgccacgccatggaggagctgccggacaccatcgagacgctcatgctgctggccctcatcgccgtcctgaccgggggcgtgaccctgttcttcctctccgggcggggcctggggaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcggcctcctcttcatgatcctgacggtggccgcgaacgagatggggctgctcgagaccaccaagaaggacctgggcatcgggcacgtcgccgtgggcaaccaccaccacgccgccatgctggacgtggacctccaccccgcctccgcgtggaccctgtacgccgtcgccacgaccatcatcacccccatgatgcgccacaccatcgagaacacgaccgccaacatcagcctgaccgccatcgcgaaccaggccgccatcctcatggggctggacaagggctggccgatctccaagatggacatcggcgtgcccctgctcgccctggggtgctacagccaggtgaaccccctgaccctcacggcggccgtcctgatgctggtggcccactacgccatcatcggccccgggctccaggccaaggcgacccgcgaggcccagaagcggaccgccgccggcatcatgaagaacccgaccgtggacgggatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgccgtcagcatggccaacatcttccgggggagctacctcgcgggcgccggcctggccttctccctgatgaagtccctcgggggcgggcgccggggcaccggggcccagggcgagaccctgggcgagaagtggaagcgccagctgaaccagctctccaagagcgagttcaacacctacaagcggtccgggatcacggaggtggaccgcagcgaggcgaaggagggcctgaagcgcggggagaccaccaagcacgccgtgtcccgcggcaccgccaagctgcggtggttcgtcgagcgcaacctggtgaagccggaggggaaggtgatcgacctcggctgcggccgcggcgggtggagctactactgcgccgggctgaagaaggtcacggaggtgaaggggtacaccaagggcgggcccggccacgaggagcccatccccatggccacctacgggtggaacctggtgaagctccactccggcaaggacgtcttcttcatcccgcccgagaagtgcgacaccctgctgtgcgacatcggggagagctcccccaaccccacgatcgaggagggccgcaccctccgggtgctgaagatggtggagccgtggctgcgcgggaaccagttctgcatcaagatcctcaacccctacatgcccagcgtcgtggagaccctggagcagatgcagcggaagcacggcggcatgctggtgcgcaaccccctctcccggaacagcacccacgagatgtactgggtctcctgcgggaccggcaacatcgtgagcgcggtgaacatgacgtcccgcatgctgctgaaccgcttcaccatggcccaccggaagccgacctacgagcgcgacgtcgacctcggggccggcacccggcacgtggccgtggagcccgaggtcgccaacctggacatcatcggccagcgcatcgagaacatcaagcacgagcacaagagcacgtggcactacgacgaggacaacccctacaagacctgggcgtaccacgggtcctacgaggtgaagcccagcggcagcgcctccagcatggtgaacggggtcgtgaagctgctcaccaagccgtgggacgtcatccccatggtgacccagatcgccatgacggacaccacccccttcggccagcagcgggtgttcaaggagaaggtcgacacccgcacgcccaaggccaagcgggggaccgcccagatcatggaggtgaccgcgaagtggctgtggggcttcctgtcccgcaacaagaagccgcggatctgcacccgcgaggagttcacgcggaaggtgcgcagcaacgccgccatcggcgccgtcttcgtggacgagaaccagtggaactccgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacaccgccggctgggacacccggatcacggaggacgacctgcagaacgaggcccgcatcaccgacatcatggagcccgagcacgcgctgctcgccaagtccatcttcaagctgacctaccagaacaaggtcgtgcgcgtgcagcggccggccaagaacgggaccgtcatggacgtgatcagccgccgggaccagcgcggctccggccaggtgggcacgtacggcctgaacaccttcaccaacatggaggcccagctcatccggcagatggagagcgaggggatcttctcccccagcgagctggagacccccaacctggccgagcgcgtcctcgactggctggagaagtacggcgtggagcggctgaagcgcatggcgatctccggggacgactgcgtggtcaagcccatcgacgaccggttcgccacggccctcaccgccctgaacgacatgggcaaggtgcgcaaggacatcccgcagtgggagcccagcaaggggtggaacgactggcagcaggtccccttctgcagccaccacttccaccagctgatcatgaaggacggccgggagatcgtcgtgccctgccgcaaccaggacgagctcgtgggccgggcccgcgtctcccagggggcgggctggagcctgcgggagaccgcctgcctggggaagtcctacgcccagatgtggcagctcatgtacttccaccgccgggacctgcgcctggccgcgaacgccatctgcagcgccgtgccggtggactggatccccacctcccggacgacctggagcatccacgcccaccaccagtggatgaccaccgaggacatgctctccgtctggaaccgcgtgtggatcgaggagaacccctggatggaggacaagacgcacatcagctcctggggcgacgtgccctacctggggaagcgcgaggaccagtggtgcggcagcctgatcggcctcaccgcccgggcgacctgggccaccaacatccaggtcgccatcaaccaggtgcgccggctgatcgggaacgagaactacctggactacatgacctccatgaagcgcttcaagaacgagagcgacccggagggcgccctctggtga

SEQ ID NO: 8848 - RNA, 9879 nt, synthetic construct
  misc_feature 1..9879: note = derived and/or modified CDS sequence (opt1) from DENV-1__HQ891314__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaccgagatggtcctgctcaccatgaaggagaagtcctggctggtgcacaagcagtggttcctggacctcccgctgccctggaccagcggggccagcacgtcccaggagacctggaaccggcaggacctgctcgtgaccttcaagaccgcccacgcgaagaagcaggaggtcgtggtgctgggcagccaggagggcgccatgcacacggccctgaccggggccaccgagatccagacctccggcacgaccaccatcttcgccgggcacctcaagtgccgcctgaagatggacaagctgaccctcaagggcatgagctacgtcatgtgcacggggtccttcaagctggagaaggaggtggcggagacccagcacggcaccgtgctggtccagatcaagtacgagggcaccgacgccccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccacggcccgcggggcccggcgcatggcgatcctgggcgacaccgcctgggacttcgggtccatcggcggcgtgttcaccagcgtcgggaagctcgtgcaccagatcttcggcaccgcctacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggcgggcatcctggcccaggggaagaagatgatccggccccagcccatggagcacaagtacagctggaagaactggggcaaggccaagatcatcggcgccgacgtgcagaactccaccttcatcatcgacgggcccaacaccccggagtgcagcgacgaccagcgcgcgtggaacatctgggaggtcgaggactacggcttcgggatcttcaccacgaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacacgctctggtccaacggcgtgctggagagcgagatgatcatccccaagatctacgggggccccatctcccagcacaactaccgcccggggtacttcacccagaccgccggcccctggcacctggggaagctcgagctggacttcgacctgtgcgagggcaccacggtggtcgtggacgagcactgcggcaaccgggggcccagcctccgcaccaccaccgtgacgggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgagcgccggctccggcgaggtggacagcttctccctggggctgctctgcatcagcatcatgatcgaggaggtgatgcggtcccgctggagccggaagatgctgatgaccggcaccctggccgtgttcttcctcctgatcatggggcagctgacgtggaacgacctcatccgcctgtgcatcatggtcggcgcgaacgcctccgaccgcatggggatgggcaccacctacctggccctcatggccaccttcaagatgcggcccatgttcgccgtgggcctgctgttccgccggctcacgagccgcgaggtgctgctgctcaccatcgggctgtccctggtcgcgagcgtggagctcccgaactccctggaggagctgggcgacgggctcgccatgggcatcatgatcctgaagctgctcaccgacttccagagccaccagctgtgggccaccctgctctccatgacgttcatcaagaccaccttcagcctgcactacgcctggaagaccatggcgatggtcctgtccatcgtgagcctcttccccctgtgcctgtccacgaccagccagaagaccacctggctccccgtgctgctgggctccctcgggtgcaagcccctgacgatgttcctgatcgccgagaacaagatctggggccggaagtcctggccgctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgcgacgacaccctgaccatcctcctgaaggccaccctgctcgccgtgagcggcgtgtaccccctgtccatcccggccacgctgttcgtctggtacttctggcagaagaagaagcagcggagcggggtgctctgggacacccccagcccgcccaaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccgtcctgggccagcgtgaagaaggacctgatctcctacggcggcgggtggcgcctccagggcagctggaacacgggggaggaggtgcaggtcatcgccgtggagcccggcaagaaccccaagaacgtgcagaccgcccccgggaccttcaagaccccggagggcgaggtcggcgccatcgcgctggacttcaagcccgggacgtccggcagccccatcgtgaaccgggaggggaagatcgtgggcctgtacggcaacggggtcgtgaccaccagcggcacctacgtgtccgccatcgcccaggccaaggcgagccaggaggggcccctcccggagatcgaggacgaggtcttccgcaagcggaacctgacgatcatggacctgcaccccggctccgggaagacccgccggtacctccccgccatcgtgcgcgaggccatcaagcggaagatgcgcaccctgatcctggccccgacccgcgtggtcgccagcgagatggcggaggccctcaagggcatgcccatccggtaccagacgaccgccgtgaagtccgagcacaccggcaaggagatcgtggacctgatgtgccacgccaccttcacgatgcgcctgctcagccccgtccgggtgcccaactacaacatgatcatcatggacgaggcccacttcaccgacccgtccagcatcgcggcccgcgggtacatctccacccgggtgggcatgggggaggccgccgccatcttcatgaccgcgacgccgcccggcagcgtcgaggccttcccccagtccaacgccgtgatccaggacgaggagcgcgacatcccggagcggagctggaactccgggtacgagtggatcaccgacttccccggcaagaccgtgtggttcgtccccagcatcaaggccggcaacgacatcgcgaactgcctgcgcaagaacgggaagcgggtgatccagctgtcccgcaagaccttcgacacggagtaccagaagaccaagaacaacgactgggactacgtggtcaccaccgacatcagcgagatgggcgccaacttccgggccgaccgcgtgatcgacccccggcgctgcctcaagccggtgatcctgaaggacgggcccgagcgggtcatcctggccggccccatgcccgtgacggtcgcctccgcggcccagcgccgggggcgcatcggccggaaccacaacaaggagggcgaccagtacatctacatggggcagccgctcaacaacgacgaggaccacgcccactggaccgaggccaagatgctgctggacaacatcaacacccccgagggcatcatccccgccctcttcgagcccgagcgcgagaagtccgcggccatcgacggggagtaccgcctgcggggcgaggcccgcaagaccttcgtggagctgatgcggcgcggggacctcccggtgtggctgtcctacaaggtcgccagcgagggcttccagtacagcgaccggcgctggtgcttcgacggcgagcggaacaaccaggtgctggaggagaacatggacgtggagatctggacgaaggagggggagcgcaagaagctccggccccgctggctggacgcccggacctactccgaccccctggcgctccgcgagttcaaggagttcgccgccggccggcgcagcgtctccggggacctgatcctggagatcggcaagctcccccagcacctgacccagcgggcccagaacgcgctggacaacctcgtgatgctgcacaacagcgagcagggcgggcgcgcctaccggcacgccatggaggagctgccggacaccatcgagacgctcatgctgctggccctcatcgccgtgctgaccggcggggtcaccctgttcttcctctccggcaaggggctgggcaagaccagcatcggcctgctctgcgtgatggcgtccagcgccctgctgtggatggcctccgtggagccccactggatcgccgccagcatcatcctcgagttcttcctgatggtcctgctcatccccgagcccgaccgccagcggaccccgcaggacaaccagctggcgtacgtggtgatcgggctcctgttcatgatcctgacggtcgccgccaacgagatgggcctgctcgagaccaccaagaaggacctggggatcggccacgtggccgtggagaaccaccaccacgccgcgatgctggacgtcgacctccaccccgcctccgcctggaccctgtacgccgtggccacgaccatcatcacccccatgatgcgccacaccatcgagaacacgaccgcgaacatcagcctgaccgccatcgccaaccaggccgcgatcctcatggggctggacaagggctggccgatctccaagatggacatcggcgtgcccctgctcgccctggggtgctacagccaggtcaaccccctgaccctcacggccgccgtgctgatgctggtggcccactacgcgatcatcggccccgggctccaggccaaggccacccgggaggcccagaagcgcaccgccgcgggcatcatgaagaacccgaccatcgacgggatcgtcgccatcgacctggaccccgtggtgtacgacgccaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtcccccggcaagttctggaacaccacgatcgcggtcagcatggccaacatcttccgggggtcctacctcgccggcgccggcctggcgttcagcctgatgaagtccctcgggggcgggcgccggggcaccggggcccagggcgagaccctgggcgagaagtggaagcgccagctgaaccagctctccaagagcgagttcaacacctacaagcggtccgggatcatggaggtggaccgcagcgaggccaaggagggcctgaagcgcggggagacgaccaagcacgccgtgtcccgcggcaccgccaagctgcggtggttcgtcgagcgcaacctcgtgaagccggaggggaaggtgatcgacctgggctgcggccgcggcgggtggagctactactgcgcggggctgaagaaggtcaccgaggtgaaggggtacacgaagggcggccccggccacgaggagcccatccccatggccacctacgggtggaacctggtgaagctccactccggcaaggacgtcttcttcatcccgcccgagaagtgcgacaccctgctgtgcgacatcggggagagctcccccaaccccaccatcgaggagggccgcacgctccgggtgctgaagatggtggagccgtggctgcgcgggaaccagttctgcatcaagatcctcaacccctacatgcccagcgtcgtggagaccctggagcagatgcagcggaagcacggcggcatgctggtgcgcaaccccctctcccggaacagcacccacgagatgtactgggtctcctgcgggaccggcaacatcgtgagcgccgtgaacatgacctcccgcatgctgctgaaccggttcacgatggcccaccgcaagccgacctacgagcgcgacgtcgacctcggggccggcacccggcacgtggcggtggagcccgaggtcgccaacctggacatcatcggccagcgcatcgagaacatcaagcacgagcacaagagcacctggcactacgacgaggacaacccctacaagacgtgggcctaccacgggtcctacgaggtgaagcccagcggctccgccagcagcatggtgaacggggtcgtgaagctgctcaccaagccgtgggacgtcatccccatggtgacccagatcgccatgaccgacacgacccccttcggccagcagcgggtgttcaaggagaaggtcgacacccgcacccccaaggcgaagcgggggacggcccagatcatggaggtgaccgcccgctggctgtggtccttcctgagccggaacaagaagccgcgcatctgcacccgggaggagttcacccgcaaggtgcggtccaacgccgcgatcggcgccgtcttcgtggacgagaaccagtggaacagcgccaaggaggccgtggaggacgaccgcttctgggacctcgtccaccgggagcgcgagctgcacaagcagggcaagtgcgccacgtgcgtgtacaacatgatggggaagcgggagaagaagctgggcgagttcgggaaggcgaagggctcccgcgccatctggtacatgtggctcggggcccggttcctggagttcgaggccctgggcttcatgaacgaggaccactggttcagccgcgagaactccctcagcggcgtggagggggagggcctgcacaagctggggtacatcctccgggacatctccaagatccccggcgggaacatgtacgccgacgacaccgcgggctgggacacccgcatcaccgaggacgacctgcagaacgaggccaagatcacggacatcatggagcccgagcacgccctgctcgccaagagcatcttcaagctgacctaccagaacaaggtcgtgcgggtgcagcgcccggccaagaacggcaccgtcatggacgtgatctcccgccgggaccagcgcgggagcggccaggtggggacctacggcctgaacacgttcaccaacatggaggcgcagctcatccggcagatggagtccgaggagatcttcagccccaacgagctggagacccccaacctggccgagcgcgtcctcgactggctggagaagtacggcgtggagcggctgaagcgcatggccatctccggggacgactgcgtggtcaagcccatcgacgaccggttcgccaccgccctcacggcgctgaacgacatgggcaaggtgcgcaaggacatcccgcagtgggagcccagcaaggggtggaacgactggcagcaggtccccttctgctcccaccacttccaccagctgatcatgaaggacggccgggagatcgtcgtgccctgccgcaaccaggacgagctcgtggggcgggcccgcgtcagccagggcgccggctggagcctgcgggagaccgcctgcctggggaagtcctacgcgcagatgtggcagctcatgtacttccaccgccgggacctgcgcctggccgccaacgccatctgcagcgccgtgccggtggactgggtccccacctcccggaccacgtggagcatccacgcgcaccaccagtggatgaccaccgaggacatgctctccgtgtggaaccgcgtgtggatcgaggagaacccctggatggaggacaagacccgggtcagctcctgggaggacgtgccctacctgggcaagcgcgaggaccagtggtgcgggagcctgatcggcctcacggcccgcgccacctgggccaccaacatccaggtggccatcaaccaggtccggcgcctgatcgggaacgagaactactccgactacatgaccagcatgaagcggttcaagaacgagtccgagccggagggcgcgctgtggtga

SEQ ID NO: 8849 - RNA, 9879 nt, synthetic construct
  misc_feature 1..9879: note = derived and/or modified CDS sequence (opt1) from DENV-1__HQ891315__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagaactggggcaaggccaagatcatcggcgccgacgtgcagaactccacgttcatcatcgacgggcccaacaccccggagtgcagcgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctctggtccaacggcgtgctggagagcgagatgatcatccccaagatctacgggggccccatctcccagcacaactaccgcccggggtacttcacgcagaccgccggcccctggcacctggggaagctcgagctggacttcgacctgtgcgagggcaccaccgtggtcgtggacgagcactgcggcaaccgggggcccagcctccgcacgaccaccgtgaccggcaagatcatccacgagtggtgctgccggtcctgcacgctgccgcccctgcgcttccgcggggaggacggctgctggtacgggatggagatccgccccgtcaaggagaaggaggagaacctcgtcaagagcatcgtgagcgccggctccggcgaggtggacagcttctccctggggctgctctgcatcagcatcatgatcgaggaggtgatgcggtcccgctggagccggaagatgctgatgaccggcaccctggccgtgttcttcctcctgatcatggggcagctgacctggaacgacctcatccgcctgtgcatcatggtcggcgcgaacgcctccgaccgcatggggatgggcacgacctacctggccctcatggccaccttcaagatgcggcccatgttcgccgtgggcctgctgttccgccggctcaccagccgcgaggtgctgctgctcacgatcgggctgtccctggtcgcgagcgtggagctcccgaactccctggaggagctgggcgacgggctcgccatgggcatcatgatcctgaagctgctcaccgacttccagagccaccagctgtgggccaccctgctctccatgaccttcatcaagacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagcccctgaccatgttcctgatcgccgagaacaagatctggggccggaagtcctggccgctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtaccccctgtccatcccggccaccctgttcgtctggtacttctggcagaagaagaagcagcggagcggggtgctctgggacacgcccagcccgcccaaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccgtcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagaccccggagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggcccctcccggagatcgaggacgaggtcttccgcaagcggaacctgaccatcatggacctgcaccccggctccgggaagacgcgccggtacctccccgccatcgtgcgcgaggccatcaagcggaagatgcgcaccctgatcctggccccgacccgcgtggtcgccagcgagatggcggaggccctcaagggcatgcccatccggtaccagaccacggccgtgaagtccgagcacaccggcaaggagatcgtggacctgatgtgccacgccaccttcaccatgcgcctgctcagccccgtccgggtgcccaactacaacatgatcatcatggacgaggcccacttcacggacccgtccagcatcgcggcccgcgggtacatctccacccgggtgggcatgggggaggccgccgccatcttcatgaccgcgacgccgcccggcagcgtcgaggccttcccccagtccaacgccgtgatccaggacgaggagcgcgacatcccggagcggagctggaactccgggtacgagtggatcacggacttccccggcaagaccgtgtggttcgtccccagcatcaaggccggcaacgacatcgcgaactgcctgcgcaagaacgggaagcgggtgatccagctgtcccgcaagaccttcgacaccgagtaccagaagacgaagaacaacgactgggactacgtggtcaccaccgacatcagcgagatgggcgccaacttccgggccgaccgcgtgatcgacccccggcgctgcctcaagccggtgatcctgaaggacgggcccgagcgggtcatcctggccggccccatgcccgtgaccgtcgcctccgcggcccagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgcggccatcgacggggagtaccgcctgcggggcgaggcccgcaagaccttcgtggagctgatgcggcgcggggacctcccggtgtggctgtcctacaaggtcgccagcgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacgtactccgaccccctggcgctccgcgagttcaaggagttcgccgccggccggcgcagcgtctccggggacctgatcctggagatcggcaagctcccccagcacctgacccagcgggcccagaacgcgctggacaacctcgtgatgctgcacaacagcgagcagggcgggcgcgcctaccggcacgccatggaggagctgccggacaccatcgagaccctcatgctgctggccctcatcgccgtgctgacgggcggggtcaccctgttcttcctctccggcaaggggctgggcaagaccagcatcggcctgctctgcgtgatggcgtccagcgccctgctgtggatggcctccgtggagccccactggatcgccgccagcatcatcctcgagttcttcctgatggtcctgctcatccccgagcccgaccgccagcggaccccgcaggacaaccagctggcgtacgtggtgatcgggctcctgttcatgatcctgaccgtcgccgccaacgagatgggcctgctcgagacgaccaagaaggacctggggatcggccacgtggccgtggagaaccaccaccacgccgcgatgctggacgtcgacctccaccccgcctccgcctggaccctgtacgccgtggccaccacgatcatcacccccatgatgcgccacaccatcgagaacaccacggcgaacatcagcctgaccgccatcgccaaccaggccgcgatcctcatggggctggacaagggctggccgatctccaagatggacatcggcgtgcccctgctcgccctggggtgctacagccaggtcaaccccctgaccctcaccgccgccgtgctgatgctggtggcccactacgcgatcatcggccccgggctccaggccaaggccacgcgggaggcccagaagcgcaccgccgcgggcatcatgaagaacccgaccatcgacgggatcgtcgccatcgacctggaccccgtggtgtacgacgccaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgcggtcagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgcggggctgaagaaggtcaccgaggtgaaggggtacaccaagggcggccccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgccgtgaacatgacctcccgcatgctgctgaaccggttcaccatggcccaccgcaagccgacgtacgagcgcgacgtcgacctcggggccggcacccggcacgtggcggtggagcccgaggtcgccaacctggacatcatcggccagcgcatcgagaacatcaagcacgagcacaagagcacctggcactacgacgaggacaacccctacaagacctgggcctaccacgggtcctacgaggtgaagcccagcggctccgccagcagcatggtgaacggggtcgtgaagctgctcacgaagccgtgggacgtcatccccatggtgacccagatcgccatgaccgacaccacgcccttcggccagcagcgggtgttcaaggagaaggtcgacacccgcacccccaaggcgaagcgggggaccgcccagatcatggaggtgacggcccgctggctgtggtccttcctgagccggaacaagaagccgcgcatctgcacccgggaggagttcacccgcaaggtgcggtccaacgccgcgatcggcgccgtcttcgtggacgagaaccagtggaacagcgccaaggaggccgtggaggacgaccgcttctgggacctcgtccaccgggagcgcgagctgcacaagcagggcaagtgcgcgacctgcgtgtacaacatgatggggaagcgggagaagaagctgggcgagttcgggaaggcgaagggctcccgcgccatctggtacatgtggctcggggcccggttcctggagttcgaggccctgggcttcatgaacgaggaccactggttcagccgcgagaactccctcagcggcgtggagggggagggcctgcacaagctggggtacatcctccgggacatctccaagatccccggcgggaacatgtacgccgacgacacggcgggctgggacacccgcatcaccgaggacgacctgcagaacgaggccaagatcaccgacatcatggagcccgagcacgccctgctcgccaagagcatcttcaagctgacgtaccagaacaaggtcgtgcgggtgcagcgcccggccaagaacggcaccgtcatggacgtgatctcccgccgggaccagcgcgggagcggccaggtggggacctacggcctgaacaccttcacgaacatggaggcgcagctcatccggcagatggagtccgaggagatcttcagccccaacgagctggagacccccaacctggccgagcgcgtcctcgactggctggagaagtacggcgtggagcggctgaagcgcatggccatctccggggacgactgcgtggtcaagcccatcgacgaccggttcgccaccgccctcaccgcgctgaacgacatgggcaaggtgcgcaaggacatcccgcagtgggagcccagcaaggggtggaacgactggcagcaggtccccttctgctcccaccacttccaccagctgatcatgaaggacggccgggagatcgtcgtgccctgccgcaaccaggacgagctcgtggggcgggcccgcgtcagccagggcgccggctggagcctgcgggagacggcctgcctggggaagtcctacgcgcagatgtggcagctcatgtacttccaccgccgggacctgcgcctggccgccaacgccatctgcagcgccgtgccggtggactgggtccccacctcccggaccacctggagcatccacgcgcaccaccagtggatgacgaccgaggacatgctctccgtgtggaaccgcgtgtggatcgaggagaacccctggatggaggacaagacccgggtcagctcctgggaggacgtgccctacctgggcaagcgcgaggaccagtggtgcgggagcctgatcggcctcaccgcccgcgccacgtgggccaccaacatccaggtggccatcaaccaggtccggcgcctgatcgggaacgagaactactccgactacatgaccagcatgaagcggttcaagaacgagtccgagccggagggcgcgctgtggtga

SEQ ID NO: 8850 - RNA, 9879 nt, synthetic construct
  misc_feature 1..9879: note = derived and/or modified CDS sequence (opt1) from DENV-1__HQ891316__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagaactggggcaaggccaagatcatcggcgccgacgtgcagaactccacgttcatcatcgacgggcccaacaccccggagtgcagcgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctctggtccaacggcgtgctggagagcgagatgatcatccccaagatctacgggggccccatctcccagcacaactaccgcccggggtacttcacgcagaccgccggcccctggcacctggggaagctcgagctggacttcgacctgtgcgagggcaccaccgtggtcgtggacgagcactgcggcaaccgggggcccagcctccgcacgaccaccgtgaccggcaagatcatccacgagtggtgctgccggtcctgcacgctgccgcccctgcgcttccgcggggaggacggctgctggtacgggatggagatccgccccgtcaaggagaaggaggagaacctcgtcaagagcatggtgagcgccggctccggcgaggtggacagcttctccctggggctgctctgcatcagcatcatgatcgaggaggtgatgcggtcccgctggagccggaagatgctgatgaccggcaccctggccgtgttcttcctcctgatcatggggcagctgacctggaacgacctcatccgcctgtgcatcatggtcggcgcgaacgcctccgaccgcatggggatgggcacgacctacctggccctcatggccaccttcaagatgcggcccatgttcgccgtgggcctgctgttccgccggctcaccagccgcgaggtgctgctgctcacgatcgggctgtccctggtcgcgagcgtggagctcccgaactccctggaggagctgggcgacgggctcgccatgggcatcatgatcctgaagctgctcaccgacttccagagccaccagctgtgggccaccctgctctccatgaccttcatcaagacgaccttcagcctgcactacgcctggaagaccatggcgatggtcctgtccatcgtgagcctcttccccctgtgcctgtccaccacgagccagaagaccacctggctccccgtgctgctgggctccctcgggtgcaagcccctgaccatgttcctgatcgccgagaacaagatctggggccggaagtcctggccgctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggacgatgaagatcaaggacgaggagcgcgacgacaccctgaccatcctcctgaaggccaccctgctcgccgtgagcggcgtgtaccccctgtccatcccggccaccctgttcgtctggtacttctggcagaagaagaagcagcggagcggggtgctctgggacacgcccagcccgcccaaggtggagcgcgccgtcctggacgacggcatctaccggatcatgcagcgcggcctgctggggcggagccaggtgggcgtgggggtcttccaggagaacgtgttccacaccatgtggcacgtgacccgcggcgcggtcctcatgtaccaggggaagcggctggagccgtcctgggccagcgtgaagaaggacctgatctcctacggcggcgggtggcgcctccagggcagctggaacaccggggaggaggtgcaggtcatcgccgtggagcccggcaagaaccccaagaacgtgcagacggcccccgggaccttcaagaccccggagggcgaggtcggcgccatcgcgctggacttcaagcccgggacctccggcagccccatcgtgaaccgggaggggaagatcgtgggcctgtacggcaacggggtcgtgacgaccagcggcacctacgtgtccgccatcgcccaggccaaggcgagccaggaggggcccctcccggagatcgaggacgaggtcttccgcaagcggaacctgaccatcatggacctgcaccccggctccgggaagacgcgccggtacctccccgccatcgtgcgcgaggccatcaagcggaagatgcgcaccctgatcctggccccgacccgcgtggtcgccagcgagatggcggaggccctcaagggcatgcccatccggtaccagaccacggccgtgaagtccgagcacaccggcaaggagatcgtggacctgatgtgccacgccaccttcaccatgcgcctgctcagccccgtccgggtgcccaactacaacatgatcatcatggacgaggcccacttcacggacccgtccagcatcgcggcccgcgggtacatctccacccgggtgggcatgggggaggccgccgccatcttcatgaccgcgacgccgcccggcagcgtcgaggccttcccccagtccaacgccgtgatccaggacgaggagcgcgacatcccggagcggagctggaactccgggtacgagtggatcacggacttccccggcaagaccgtgtggttcgtccccagcatcaaggccggcaacgacatcgcgaactgcctgcgcaagaacgggaagcgggtgatccagctgtcccgcaagaccttcgacaccgagtaccagaagacgaagaacaacgactgggactacgtggtcaccaccgacatcagcgagatgggcgccaacttccgggccgaccgcgtgatcgacccccggcgctgcctcaagccggtgatcctgaaggacgggcccgagcgggtcatcctggccggccccatgcccgtgaccgtcgcctccgcggcccagcgccgggggcgcatcggccggaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgcgagaagtccgcggccatcgacggggagtaccgcctgcggggcgaggcccgcaagaccttcgtggagctgatgcggcgcggggacctcccggtgtggctgtcctacaaggtcgccagcgagggcttccagtacagcgaccggcgctggtgcttcgacggcgagcggaacaaccaggtgctggaggagaacatggacgtggagatctggaccaaggagggggagcgcaagaagctccggccccgctggctggacgcccggacgtactccgaccccctggcgctccgcgagttcaaggagttcgccgccggccggcgcagcgtctccggggacctgatcctggagatcggcaagctcccccagcacctgacccagcgggcccagaacgcgctggacaacctcgtgatgctgcacaacagcgagcagggcgggcgcgcctaccggcacgccatggaggagctgccggacaccatcgagaccctcatgctgctggccctcatcgccgtgctgacgggcggggtcaccctgttcttcctctccggcaaggggctgggcaagaccagcatcggcctgctctgcgtgatggcgtccagcgccctgctgtggatggcctccgtggagccccactggatcgccgccagcatcatcctcgagttcttcctgatggtcctgctcatccccgagcccgaccgccagcggaccccgcaggacaaccagctggcgtacgtggtgatcgggctcctgttcatgatcctgaccgtcgccgccaacgagatgggcctgctcgagacgaccaagaaggacctggggatcggccacgtggccgtggagaaccaccaccacgccgcgatgctggacgtcgacctccaccccgcctccgcctggaccctgtacgccgtggccaccacgatcatcacccccatgatgcgccacaccatcgagaacaccacggcgaacatcagcctgaccgccatcgccaaccaggccgcgatcctcatggggctggacaagggctggccgatctccaagatggacatcggcgtgcccctgctcgccctggggtgctacagccaggtcaaccccctgaccctcaccgccgccgtgctgatgctggtggcccactacgcgatcatcggccccgggctccaggccaaggccacgcgggaggcccagaagcgcaccgccgcgggcatcatgaagaacccgaccatcgacgggatcgtcgccatcgacctggaccccgtggtgtacgacgccaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgcggtcagcatggccaacatcttccgggggtcctacctcgccggcgccggcctggcgttcagcctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggccaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgcggggctgaagaaggtcaccgaggtgaaggggtacaccaagggcggccccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgccgtgaacatgacctcccgcatgctgctgaaccggttcaccatggcccaccgcaagccgacgtacgagcgcgacgtcgacctcggggccggcacccggcacgtggcggtggagcccgaggtcgccaacctggacatcatcggccagcgcatcgagaacatcaagcacgagcacaagagcacctggcactacgacgaggacaacccctacaagacctgggcctaccacgggtcctacgaggtgaagcccagcggctccgccagcagcatggtgaacggggtcgtgaagctgctcacgaagccgtgggacgtcatccccatggtgacccagatcgccatgaccgacaccacgcccttcggccagcagcgggtgttcaaggagaaggtcgacacccgcacccccaaggcgaagcgggggaccgcccagatcatggaggtgacggcccgctggctgtggtccttcctgagccggaacaagaagccgcgcatctgcacccgggaggagttcacccgcaaggtgcggtccaacgccgcgatcggcgccgtcttcgtggacgagaaccagtggaacagcgccaaggaggccgtggaggacgaccgcttctgggacctcgtccaccgggagcgcgagctgcacaagcagggcaagtgcgcgacctgcgtgtacaacatgatggggaagcgggagaagaagctgggcgagttcgggaaggcgaagggctcccgcgccatctggtacatgtggctcggggcccggttcctggagttcgaggccctgggcttcatgaacgaggaccactggttcagccgcgagaactccctcagcggcgtggagggggagggcctgcacaagctggggtacatcctccgggacatctccaagatccccggcgggaacatgtacgccgacgacacggcgggctgggacacccgcatcaccgaggacgacctgcagaacgaggccaagatcaccgacatcatggagcccgagcacgccctgctcgccaagagcatcttcaagctgacgtaccagaacaaggtcgtgcgggtgcagcgcccggccaagaacggcaccgtcatggacgtgatctcccgccgggaccagcgcgggagcggccaggtggggacctacggcctgaacaccttcacgaacatggaggcgcagctcatccggcagatggagtccgaggagatcttcagccccaacgagctggagacccccaacctggccgagcgcgtcctcgactggctggagaagtacggcgtggagcggctgaagcgcatggccatctccggggacgactgcgtggtcaagcccatcgacgaccggttcgccaccgccctcaccgcgctgaacgacatgggcaaggtgcgcaaggacatcccgcagtgggagcccagcaaggggtggaacgactggcagcaggtccccttctgctcccaccacttccaccagctgatcatgaaggacggccgggagatcgtcgtgccctgccgcaaccaggacgagctcgtggggcgggcccgcgtcagccagggcgccggctggagcctgcgggagacggcctgcctggggaagtcctacgcgcagatgtggcagctcatgtacttccaccgccgggacctgcgcctggccgccaacgccatctgcagcgccgtgccggtggactgggtccccacctcccggaccacctggagcatccacgcgcaccaccagtggatgacgaccgaggacatgctctccgtgtggaaccgcgtgtggatcgaggagaacccctggatggaggacaagacccgggtcagctcctgggaggacgtgccctacctgggcaagcgcgaggaccagtggtgcgggagcctgatcggcctcaccgcccgcgccacgtgggccaccaacatccaggtggccatcaaccaggtccggcgcctgatcgggaacgagaactactccgactacatgaccagcatgaagcggttcaagaacgagtccgagccggagggcgcgctgtggtga

SEQ ID NO: 8851 - RNA, 9879 nt, synthetic construct
  misc_feature 1..9879: note = derived and/or modified CDS sequence (opt1) from DENV-1__JN054256__SS-prME
  source 1..9879: mol_type = other RNA
agcgtgaccatgctgctcatgctgatgcccaccgccctggccttccacctcacgacccgggagggcgagccccacatgatcgtgagcaagcaggagcggggcaagagcctgctgttcaagaccagcgccggcgtgaacatgtgcaccctcatcgccatggacctgggggagctgtgcgaggacaccatgacctacaagtgcccccggatcaccgaggccgagcccgacgacgtggactgctggtgcaacgccaccgacacgtgggtcacctacgggacctgcagccagaccggggagcaccggcgcgacaagcggtccgtggccctcgcgccccacgtgggcctgggcctggagacgcgcaccgagacctggatgagctccgagggggcctggaagcagatccagcgggtcgagacctgggccctccgccaccccggcttcacggtgatcgccctgttcctggcgcacgccatcgggaccagcatcacccagaagggcatcatcttcatcctcctgatgctggtgaccccctccatggccatgcggtgcgtcgggatcggcagccgcgacttcgtggagggcctctccggggccacgtgggtggacgtcgtgctggagcacggcagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggggaggccaccctggtggaggagcaggacgccaacttcgtctgccggcgcaccttcgtggaccggggctggggcaacgggtgcggcctgttcgggaagggctccctcctgacgtgcgccaagttcaagtgcgtgaccaagctggaggggaagatcgtccagtacgagaacctcaagtacagcgtgatcgtgaccgtccacaccggcgaccagcaccaggtgggcaacgagtccacggagcacgggaccaccgcgaccatcacgccccaggcccccacgaccgagatccagctgaccgactacggcgccctgaccctcgactgcagcccccgcacggggctggacttcaccgagatggtcctgctcaccatgaaggagaagtcctggctggtgcacaagcagtggttcctggacctcccgctgccctggaccagcggcgccagcacgtcccaggagacctggaaccggcaggacctgctcgtgaccttcaagaccgcccacgcgaagaagcaggaggtcgtggtgctggggagccaggagggcgccatgcacacggccctgaccggcgccaccgagatccagacctccgggacgaccaccatcttcgccggccacctcaagtgccgcctgaagatggacaagctgaccctcaaggggatgagctacgtcatgtgcacgggctccttcaagctggagaaggaggtggcggagacccagcacgggaccgtgctggtccagatcaagtacgagggcaccgacgccccctgcaagatccccttcagcacgcaggacgagaagggcgtgacccagaacgggcggctgatcaccgccaacccgatcgtgaccgacaaggagaagcccgtcaacatcgaggccgagccgcccttcggcgagtcctacatcgtgatcggggcgggcgagaaggccctcaagctgagctggttcaagaagggctccagcatcgggaagatgttcgaggccacggcccgcggcgcccggcgcatggcgatcctgggggacaccgcctgggacttcggctccatcgggggcgtgttcaccagcgtcggcaagctcgtgcaccagatcttcgggaccgcctacggcgtgctgttctccggggtcagctggacgatgaagatcggcatcggggtgctgctcacctggctgggcctgaactcccgcagcacctccctcagcatgacctgcatcgccgtgggcctggtcacgctgtacctcggggtgatggtgcaggccgactccggctgcgtcatcaactggaaggggcgggagctgaagtgcggcagcgggatcttcgtgaccaacgaggtgcacacctggaccgagcagtacaagttccaggcggacagcccgaagcgcctgtccgccgccatcggcaaggcctgggaggagggcgtctgcgggatccggagcgccacccgcctcgagaacatcatgtggaagcagatctccaacgagctgaaccacatcctgctcgagaacgacatgaagctgacggtggtggtcggcgacgtggcggggatcctggcccagggcaagaagatgatccggccccagcccatggagcacaagtacagctggaagaactgggggaaggccaagatcatcggcgccgacgtgcagaactccaccttcatcatcgacggccccaacaccccggagtgcagcgacgaccagcgcgcgtggaacatctgggaggtcgaggactacgggttcggcatcttcaccacgaacatctggctcaagctgcgggactcctacacccaggtgtgcgaccaccgcctgatgagcgccgccatcaaggactccaaggccgtgcacgccgacatggggtactggatcgagagcgagaagaacgagacctggaagctcgcgcgggcctccttcatcgaggtcaagacctgcatctggcccaagagccacacgctgtggtccaacggcgtgctggagagcgagatgatcatccccaagatctacggcgggcccatctcccagcacaactaccgcccgggctacttcacccagaccgccgggccctggcacctcggcaagctggagctggacttcgacctctgcgaggggaccacggtggtcgtggacgagcactgcggcaaccggggccccagcctgcgcaccaccaccgtgacggggaagatcatccacgagtggtgctgccggtcctgcaccctgccgcccctccgcttccggggcgaggacgggtgctggtacggcatggagatccgccccgtcaaggagaaggaggagaacctggtgaagtccatggtgagcgccgggtccggcgaggtcgacagcttctccctgggcctcctgtgcatcagcatcatgatcgaggaggtgatgcggtcccgctggagccggaagatgctgatgaccgggaccctcgccgtgttcttcctgctgatcatgggccagctcacgtggaacgacctgatccgcctgtgcatcatggtcggggcgaacgcctccgaccgcatgggcatggggaccacctacctcgccctgatggccaccttcaagatgcggcccatgttcgccgtgggcctcctgttccgccggctgacgagccgcgaggtgctgctcctgaccatcggcctgtccctcgtcgcgagcgtggagctgccgaactccctggaggagctcggggacggcctggccatggggatcatgatcctgaagctcctgatcgacttccagagccaccagctgtgggccaccctcctgtccatgaccttcatcaagacgaccttcagcctgcactacgcctggaagaccatggcgatggtcctctccatcgtgagcctgttccccctgtgcctctccaccacgagccagaagaccacctggctgcccgtgctgctcggctccctgggctgcaagcccctgaccatgttcctcatcgccgagaacaagatctgggggcgcaagagctggccgctgaacgagggcatcatggccgtcgggatcgtgagcatcctgctctccagcctgctgaagaacgacgtgcccctcgccggccccctgatcgccgggggcatgctgatcgcgtgctacgtcatctccggcagctccgccgacctcagcctggagaaggccgccgaggtgtcctgggaggaggaggccgagcacagcggggcgtcccacaacatcctggtggaggtccaggacgacggcacgatgaagatcaaggacgaggagcgcgacgacaccctcaccatcctgctgaaggccaccctcctggccgtgagcggggtgtaccccctgtccatcccggccaccctcttcgtctggtacttctggcagaagaagaagcagcggagcggcgtgctgtgggacacgcccagcccgcccaaggtggagcgcgccgtcctggacgacgggatctaccggatcatgcagcgcggcctgctcggccggagccaggtgggggtgggcgtcttccaggagaacgtgttccacaccatgtggcacgtgacccgcggggcggtcctgatgtaccagggcaagcggctggagccgtcctgggccagcgtgaagaaggacctcatctcctacgggggcggctggcgcctgcaggggagctggaacaccggcgaggaggtgcaggtcatcgccgtggagcccgggaagaaccccaagaacgtgcagacggcccccggcaccttcaagaccccggagggggaggtcggcgccatcgcgctggacttcaagcccggcacctccgggagccccatcgtgaaccgggagggcaagatcgtggggctctacggcaacggcgtcgtgacgaccagcgggacctacgtgtccgccatcgcccaggccaaggcgagccaggagggccccctgccggagatcgaggacgaggtcttccgcaagcggaacctgaccatcatggacctccaccccgggtccggcaagacgcgccggtacctgcccgccatcgtgcgcgaggccatcaagcggaagatgcgcaccctgatcctcgccccgacccgcgtggtcgccagcgagatggcggaggccctgaaggggatgcccatccggtaccagaccacggccgtgaagtccgagcacaccggcaaggagatcgtggacctgatgtgccacgccaccttcaccatgcgcctcctgagccccgtccgggtgcccaactacaacatgatcatcatggacgaggcccacttcacggacccgtccagcatcgcggcccgcggctacatctccacccgggtggggatgggcgaggccgccgccatcttcatgaccgcgacgccgcccgggagcgtcgaggccttcccccagtccaacgccgtgatccaggacgaggagcgcgacatcccggagcggagctggaactccggctacgagtggatcacggacttccccgggaagaccgtgtggttcgtccccagcatcaaggccggcaacgacatcgcgaactgcctgcgcaagaacggcaagcgggtgatccagctctcccgcaagaccttcgacaccgagtaccagaagacgaagaacaacgactgggactacgtggtcaccaccgacatcagcgagatgggggccaacttccgggccgaccgcgtgatcgacccccggcgctgcctgaagccggtgatcctgaaggacggccccgagcgggtcatcctcgccgggcccatgcccgtgaccgtcgcctccgcggcccagcgccggggccgcatcgggcggaaccacaacaaggagggcgaccagtacatctacatgggccagccgctgaacaacgacgaggaccacgcccactggacggaggccaagatgctgctcgacaacatcaacacccccgaggggatcatccccgccctgttcgagcccgagcgcgagaagtccgcggccatcgacggcgagtaccgcctgcgcggggaggcccgcaagaccttcgtggagctcatgcggcgcggcgacctgccggtgtggctgtcctacaaggtcgccagcgaggggttccagtacagcgaccggcgctggtgcttcgacggcgagcggaacaaccaggtgctcgaggagaacatggacgtggagatctggaccaaggagggcgagcgcaagaagctgcggccccgctggctggacgcccggacgtactccgaccccctcgcgctgcgcgagttcaaggagttcgccgccgggcggcgcagcgtctccggcgacctgatcctcgagatcgggaagctgccccagcacctgacccagcgggcccagaacgcgctcgacaacctggtgatgctgcacaacagcgagcagggcggccgcgcctaccggcacgccatggaggagctcccggacaccatcgagaccctgatgctgctcgccctgatcgccgtgctgaccggcggggtcaccctcttcttcctgtccgggaaggggctggggaagaccagcatcggcctcctgtgcgtgatggcgtccagcgccctgctctggatggcctccgtggagccccactggatcgccgccagcatcatcctggagttcttcctgatggtcctcctgatccccgagcccgaccgccagcggaccccgcaggacaaccagctggcgtacgtggtgatcggcctcctgttcatgatcctgaccgtcgccgccaacgagatggggctcctggagacgaccaagaaggacctgggcatcgggcacgtggccgtggagaaccaccaccacgccgcgatgctcgacgtcgacctgcaccccgcctccgcctggaccctgtacgccgtggccaccacgatcatcacccccatgatgcgccacaccatcgagaacaccacggcgaacatcagcctcaccgccatcgccaaccaggccgcgatcctgatgggcctggacaaggggtggccgatctccaagatggacatcggcgtgcccctcctggccctgggctgctacagccaggtcaaccccctcaccctgaccgccgccgtgctgatgctcgtggcccactacgcgatcatcgggcccggcctgcaggccaaggccacgcgggaggcccagaagcgcaccgccgcggggatcatgaagaacccgaccatcgacggcatcgtcgccatcgacctggaccccgtggtgtacgacgccaagttcgagaagcagctcgggcagatcatgctgctgatcctctgcacctcccagatcctgctgatgcgcacgacctgggccctctgcgagagcatcaccctggccaccggccccctgacgaccctctgggagggctcccccgggaagttctggaacaccaccatcgcggtcagcatggccaacatcttccggggctcctacctggccggggccggcctggcgttcagcctcatgaagtccctgggcgggggccgccgggggacgggcgcccagggggagaccctgggcgagaagtggaagcgccagctcaaccagctgtccaagagcgagttcaacacctacaagcggtccggcatcatggaggtggaccgcagcgaggccaaggaggggctgaagcggggcgagaccacgaagcacgccgtgtcccgcgggaccgccaagctccggtggttcgtcgagcgcaacctggtgaagccggagggcaaggtgatcgacctggggtgcggccggggcgggtggagctactactgcgcgggcctgaagaaggtcaccgaggtgaaggggtacaccaagggcgggcccggccacgaggagcccatccccatggccacgtacggctggaacctcgtgaagctgcactccgggaaggacgtcttcttcatcccgcccgagaagtgcgacaccctgctctgcgacatcggcgagagctcccccaaccccaccatcgaggaggggcgcaccctgcgggtgctgaagatggtggagccgtggctccgcggcaaccagttctgcatcaagatcctgaacccctacatgcccagcgtcgtggagacgctggagcagatgcagcggaagcacgggggcatgctcgtgcgcaaccccctgtcccggaacagcacccacgagatgtactgggtctcctgcggcaccgggaacatcgtgagcgccgtgaacatgacctcccgcatgctgctcaaccggttcaccatggcccaccgcaagccgacgtacgagcgcgacgtcgacctgggcgccgggacccggcacgtggcggtggagcccgaggtcgccaacctggacatcatcggccagcgcatcgagaacatcaagcacgagcacaagagcacctggcactacgacgaggacaacccctacaagacctgggcctaccacggctcctacgaggtgaagcccagcgggtccgccagcagcatggtgaacggcgtcgtgaagctcctgacgaagccgtgggacgtcatccccatggtgacccagatcgccatgaccgacaccacgcccttcgggcagcagcgggtgttcaaggagaaggtcgacacccgcacccccaaggcgaagcggggcaccgcccagatcatggaggtgacggcccgctggctgtggtccttcctcagccggaacaagaagccgcgcatctgcacccgggaggagttcacccgcaaggtgcggtccaacgccgcgatcggggccgtcttcgtggacgagaaccagtggaacagcgccaaggaggccgtggaggacgaccgcttctgggacctggtccaccgggagcgcgagctgcacaagcagggcaagtgcgcgacctgcgtgtacaacatgatgggcaagcgggagaagaagctcggggagttcggcaaggcgaaggggtcccgcgccatctggtacatgtggctgggcgcccggttcctggagttcgaggccctcgggttcatgaacgaggaccactggttcagccgcgagaactccctgagcggcgtggagggcgaggggctgcacaagctcggctacatcctgcgggacatctccaagatccccgggggcaacatgtacgccgacgacacggcggggtgggacacccgcatcaccgaggacgacctgcagaacgaggccaagatcaccgacatcatggagcccgagcacgccctcctggccaagagcatcttcaagctgacgtaccagaacaaggtcgtgcgggtgcagcgcccggccaagaacggcaccgtcatggacgtgatctcccgccgggaccagcgcggcagcggccaggtgggcacctacgggctcaacaccttcacgaacatggaggcgcagctgatccggcagatggagtccgaggagatcttcagccccaacgagctggagacccccaacctcgccgagcgcgtcctggactggctggagaagtacggcgtggagcggctcaagcgcatggccatctccggcgacgactgcgtggtcaagcccatcgacgaccggttcgccaccgccctgaccgcgctgaacgacatggggaaggtgcgcaaggacatcccgcagtgggagcccagcaagggctggaacgactggcagcaggtccccttctgctcccaccacttccaccagctcatcatgaaggacgggcgggagatcgtcgtgccctgccgcaaccaggacgagctggtgggccgggcccgcgtcagccagggggccggctggagcctgcgggagacggcctgcctcggcaagtcctacgcgcagatgtggcagctgatgtacttccaccgccgggacctgcgcctcgccgccaacgccatctgcagcgccgtgccggtggactgggtccccacctcccggaccacctggagcatccacgcgcaccaccagtggatgacgaccgaggacatgctgtccgtgtggaaccgcgtgtggatcgaggagaacccctggatggaggacaagacccgggtcagctcctgggaggacgtgccctacctggggaagcgcgaggaccagtggtgcggcagcctcatcgggctgaccgcccgcgccacgtgggccaccaacatccaggtggccatcaaccaggtccggcgcctgatcggcaacgagaactactccgactacatgaccagcatgaagcggttcaagaacgagtccgagccggagggggcgctctggtga

SEQ ID NO: 8852 - RNA, 9879 nt, synthetic construct
  misc_feature 1..9879: note = derived and/or modified CDS sequence (opt1) from DENV-1__JN054255__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgccggggtgaacatgtgcaccctcatcgccatggacctgggcgagctgtgcgaggacacgatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctcccgctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagatgtccggcaccaccacgatcttcgccgggcacctcaagtgccgcctgaagatggacaagctgaccctcaagggcatgagctacgtcatgtgcaccgggtccttcaagctggagaaggaggtggcggagacccagcacggcacggtgctggtccagatcaagtacgagggcaccgacgccccctgcaagatccccttcagcacccaggacgagaagggggtgacccagaacggccggctgatcacggccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacaccgcctgggacttcgggtccatcggcggcgtgttcacgagcgtcgggaagctcgtgcaccagatcttcggcaccgcctacggggtgctgttctccggcgtcagctggaccatgaagatcgggatcggcgtgctgctcacctggctgggcctgaactcccgcagcacgtccctcagcatgacctgcatcgccgtggggctggtcaccctgtacctcggcgtgatggtgcaggccgactccgggtgcgtcatcaactggaagggccgggagctgaagtgcgggagcggcatcttcgtgaccaacgaggtgcacacgtggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagaactggggcaaggccaagatcatcggcgccgacgtgcagaactccaccttcatcatcgacgggcccaacacgccggagtgcagcgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacgtggaagctggcgcgggcctccttcatcgaggtcaagacctgcatctggcccaagagccacaccctctggtccaacggcgtgctggagagcgagatgatcatccccaagatctacgggggccccatctcccagcacaactaccgcccggggtacttcacccagacggccggcccctggcacctggggaagctcgagctggacttcgacctgtgcgagggcaccaccgtggtcgtggacgagcactgcggcaaccgggggcccagcctccgcaccacgaccgtgaccggcaagatcatccacgagtggtgctgccggtcctgcaccctgccgcccctgcgcttccgcggggaggacggctgctggtacgggatggagatccgccccgtcaaggagaaggaggagaacctcgtcaagagcatggtgagcgccggctccggcgaggtggacagcttctccctggggctgctctgcatcagcatcatgatcgaggaggtgatgcggtcccgctggagccggaagatgctgatgacgggcaccctggccgtgttcttcctcctgatcatggggcagctgacctggaacgacctcatccgcctgtgcatcatggtcggcgcgaacgcctccgaccgcatggggatgggcaccacgtacctggccctcatggccaccttcaagatgcggcccatgttcgccgtgggcctgctgttccgccggctcaccagccgcgaggtgctgctgctcaccatcgggctgtccctggtcgcgagcgtggagctcccgaactccctggaggagctgggcgacgggctcgccatgggcatcatgatcctgaagctgctcacggacttccagagccaccagctgtgggccaccctgctctccatgaccttcatcaagaccacgttcagcctgcactacgcctggaagaccatggcgatggtcctgtccatcgtgagcctcttccccctgtgcctgtccaccaccagccagaagacgacctggctccccgtgctgctgggctccctcgggtgcaagcccctgaccatgttcctgatcgccgagaacaagatctggggccggaagtcctggccgctcaacgaggggatcatggccgtcggcatcgtgagcatcctgctgtccagcctcctgaagaacgacgtgcccctggccgggcccctcatcgccggcggcatgctgatcgcgtgctacgtcatctccgggagctccgccgacctgagcctcgagaaggccgccgaggtgtcctgggaggaggaggccgagcacagcggcgcgtcccacaacatcctggtggaggtccaggacgacgggaccatgaagatcaaggacgaggagcgcgacgacacgctgaccatcctcctgaaggccaccctgctcgccgtgagcggcgtgtaccccctgtccatcccggccaccctgttcgtctggtacttctggcagaagaagaagcagcggagcggggtgctctgggacacccccagcccgcccaaggtggagaaggccgtcctggacgacggcatctaccgcatcatgcagcggggcctgctggggcgcagccaggtgggcgtgggggtcttccaggagaacgtgttccacacgatgtggcacgtgacccggggcgcggtcctcatgtaccaggggaagcgcctggagccgtcctgggccagcgtgaagaaggacctgatctcctacggcggcgggtggcggctccagggcagctggaacaccggggaggaggtgcaggtcatcgccgtggagcccggcaagaaccccaagaacgtgcagaccgcccccgggacgttcaagaccccggagggcgaggtcggcgccatcgcgctggacttcaagcccgggacctccggcagccccatcgtgaaccgcgaggggaagatcgtgggcctgtacggcaacggggtcgtgaccacgagcggcacctacgtgtccgggatcgcccaggccaaggccagccaggagggccccctcccggagatcgaggacgaggtcttccggaagcgcaacctgaccatcatggacctgcaccccgggtccggcaagacccggcgctacctccccgcgatcgtgcgggaggccatcaagcgcaagatgcggacgctgatcctggccccgacccgcgtggtcgccagcgagatggccgaggcgctcaagggcatgcccatccgctaccagaccaccgccgtgaagtccgagcacacggggaaggagatcgtggacctgatgtgccacgccaccttcaccatgcggctgctcagccccgtccgcgtgcccaactacaacatgatcatcatggacgaggcccacttcaccgacccgtccagcatcgccgcgcggggctacatctccacgcgcgtggggatgggcgaggccgccgccatcttcatgaccgccacgccgcccgggagcgtcgaggcgttcccccagtccaacgccgtgatccaggacgaggagcgggacatcccggagcgcagctggaactccggctacgagtggatcaccgacttccccggcaagacggtgtggttcgtccccagcatcaaggccgggaacgacatcgccaactgcctgcggaagaacggcaagcgcgtgatccagctgtcccggaagaccttcgacaccgagtaccagaagaccaagaacaacgactgggactacgtggtcacgaccgacatcagcgagatgggggcgaacttccgcgccgaccgggtgatcgacccccgccggtgcctcaagccggtgatcctgaaggacggccccgagcgcgtcatcctggccgggcccatgcccgtgaccgtcgcctccgccgcgcagcggcgcggccggatcggccgcaaccacaacaaggagggggaccagtacatctacatgggccagccgctcaacaacgacgagaaccacgcccactggaccgaggccaagatgctgctggacaacatcaacacgcccgaggggatcatccccgccctcttcgagcccgagcgggagaagtccgccgcgatcgacggcgagtaccgcctgcgcggggaggcccggaagaccttcgtggagctgatgcgccggggcgacctcccggtgtggctgtcctacaaggtcgccagcgagggcttccagtacagcgaccgccggtggtgcttcgacggggagcgcaacaaccaggtgctggaggagaacatggacgtggagatctggaccaaggagggcgagcggaagaagctccgcccccggtggctggacgcccgcacctactccgaccccctggccctccgggagttcaaggagttcgcggccgggcgccggagcgtctccggcgacctgatcctggagatcggcaagctcccccagcacctgacgcagcgcgcccagaacgccctggacaacctcgtgatgctgcacaacagcgagcagggcgggcgggcgtaccgccacgccatggaggagctgccggacaccatcgagaccctcatgctgctggccctcatcgccgtgctgaccgggggcgtcacgctgttcttcctctccgggaagggcctgggcaagaccagcatcgggctgctctgcgtgatggcctccagcgcgctgctgtggatggcctccgtggagccccactggatcgccgccagcatcatcctcgagttcttcctgatggtcctgctcatccccgagcccgaccggcagcgcaccccgcaggacaaccagctggcctacgtggtgatcggcctcctgttcatgatcctgaccgtcgcggccaacgagatggggctgctcgagaccacgaagaaggacctgggcatcgggcacgtggccgtggagaaccaccaccacgccgccatgctggacatcgacctccaccccgcgtccgcctggaccctgtacgccgtcgccaccaccatcatcacgcccatgatgcggcacaccatcgagaacaccaccgccaacatcagcctgacggcgatcgccaaccaggccgccatcctcatgggcctggacaagggctggccgatctccaagatggacatcggggtgcccctgctcgcgctgggctgctacagccaggtgaaccccctgaccctcaccgccgccgtcctgatgctggtggcccactacgccatcatcgggcccggcctccaggcgaaggccacccgcgaggcccagaagcggacggccgccgggatcatgaagaacccgaccatcgacggcatcgtggcgatcgacctggaccccgtcgtgtacgacgccaagttcgagaagcagctgggccagatcatgctcctgatcctgtgcacctcccagatcctcctgatgcgcaccacgtgggccctgtgcgagagcatcaccctcgccaccgggcccctgaccacgctgtgggagggctcccccgggaagttctggaacaccaccatcgccgtgagcatggcgaacatcttccgcggctcctacctcgccggcgccgggctggccttcagcctgatgaagtccctcggcgggggccggcgcgggaccggcgcgcagggcgagacgctgggggagaagtggaagcggcagctgaaccagctctccaagagcgagttcaacacctacaagcgctccggcatcatggaggtcgaccggagcgaggccaaggaggggctgaagcgcggcgagaccaccaagcacgccgtgtcccgggggacggccaagctgcgctggttcgtggagcggaacctcgtcaagccggagggcaaggtgatcgacctgggctgcgggcgcggcgggtggagctactactgcgccggcctgaagaaggtgaccgaggtcaaggggtacaccaagggcggccccgggcacgaggagcccatccccatggcgacctacggctggaacctggtgaagctccactccgggaaggacgtgttcttcatcccgcccgagaagtgcgacacgctgctgtgcgacatcggcgagagctcccccaaccccaccatcgaggaggggcggaccctccgcgtcctgaagatggtggagccgtggctgcggggcaaccagttctgcatcaagatcctcaacccctacatgcccagcgtggtcgagaccctggagcagatgcagcgcaagcacggcgggatgctggtgcggaaccccctctcccgcaacagcacgcacgagatgtactgggtgtcctgcggcaccgggaacatcgtcagcgccgtgaacatgacctcccggatgctgctgaaccgcttcaccatggcccaccggaagccgacctacgagcgcgacgtggacctcggcgccggcacgcgccacgtcgccgtggagcccgaggtggcgaacctggacatcatcgggcagcggatcgagaacatcaagcacgagcacaagagcacctggcactacgacgaggacaacccctacaagacctgggcctaccacggctcctacgaggtcaagcccagcgggtccgccagcagcatggtgaacggcatggtgaagctgctcaccaagccgtgggacgtcatccccatggtgacgcagatcgccatgaccgacaccacccccttcgggcagcagcgcgtcttcaaggagaaggtggacacgcggacccccaaggccaagcgcggcaccgcgcagatcatggaggtgaccgcccggtggctgtggtccttcctgagccgcaacaagaagccgcggatctgcacgcgcgaggagttcacccggaaggtccgctccaacgccgccatcggcgcggtgttcgtggacgagaaccagtggaacagcgccaaggaggccgtcgaggacgaccggttctgggacctcgtgcaccgcgagcgggagctgcacaagcaggggaagtgcgcgacctgcgtgtacaacatgatgggcaagcgcgagaagaagctgggggagttcggcaaggccaaggggtcccgggcgatctggtacatgtggctcggcgcccgcttcctggagttcgaggccctgggcttcatgaacgaggaccactggttcagccgggagaactccctcagcggggtcgagggcgaggggctgcacaagctgggctacatcctccgcgacatctccaagatccccgggggcaacatgtacgccgacgacaccgccggctgggacacgcggatcaccgaggacgacctgcagaacgaggcgaagatcaccgacatcatggagcccgagcacgccctgctcgccaagagcatcttcaagctgacctaccagaacaaggtggtgcgcgtccagcggccgtccaagaacgggacggtgatggacgtgatcagccgccgcgaccagcggggctccgggcaggtcggcacctacggcctgaacaccttcaccaacatggaggcccagctcatccgccagatggagagcgaggagatcttctcccccaacgagctggagacgcccaacctggccaagcgggtgctcgactggctggagaagtacggggtggagcgcctgaagcggatggcgatcagcggcgacgactgcgtcgtgaagcccatcgacgaccgcttcgccaccgccctcaccgccctgaacgacatggggaaggtgcggaaggacatcccgcagtgggagccctccaagggctggaacgactggcagcaggtccccttctgcagccaccacttccaccagctgatcatgaaggacgggcgcgagatcgtggtgccctgccggaaccaggacgagctcgtcggccgcgcccgggtgagccagggcgcggggtggtccctgcgcgagaccgcctgcctgggcaagagctacgcccagatgtggcagctcatgtacttccaccggcgcgacctgcggctggccgcgaacgccatctgctccgccgtgccggtcgactgggtgcccacgagccgcaccacctggtccatccacgcccaccaccagtggatgaccacggaggacatgctcagcgtgtggaaccgggtctggatcgaggagaacccctggatggaggacaagacccgcgtgtccagctgggaggacgtgccctacctggggaagcgggaggaccagtggtgcggctccctgatcgggctcaccgcccgcgcgacctgggccacgaacatccaggtcgccatcaaccaggtgcgccggctgatcggcaacgagaactacagcgactacatgacctccatgaagcgcttcaagaacgagagcgagccggagggcgccctgtggtga

SEQ ID NO: 8853 - RNA, 9879 nt, synthetic construct
  misc_feature 1..9879: note = derived and/or modified CDS sequence (opt1) from DENV-1__KP406801__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacaccatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaagaacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacgccaacttcgtctgccggcgcacgttcgtggaccggggctgggggaacggctgcggcctcttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgccaccatcacgccccaggcgcccaccagcgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgccaagaagcaggaggtcgtggtgctgggctcccaggagggcgcgatgcacaccgccctcgccggggccacggagatccagatgagcggcaccaccaccatcttcgccgggcacctgaagtgccgcctgaagatggacaagctcacgctgaagggcgtctcctacgtgatgtgcaccgggagcttcaagctggagaaggaggtggcggagacccagcacggcaccgtcctggtccaggtgaagtacgagggcacggacgccccctgcaagatccccttctccatccaggacgagaagggggtcacccagaacggccggctcatcaccgccaacccgatcgccaccgacaaggagaagcccgtgaacatcgagacggagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtcttcacctccgtggggaagctggtgcaccaggtcttcggcacggcctacggggtgctgttcagcggcgtgtcctggaccatgaagatcgggatcggcatcctcctgacctggctgggcctcaacagccgctccaccagcctgtccatgacgtgcatcgccgtcgggatggtgaccctgtacctcggcgtgatggtccaggccgacagcgggtgcgtgatcaactggaagggccgggagctgaagtgcgggtccggcatcttcgtgaccaacgaggtccacacctggacggagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtggtcgtgggggacgcgaacggcatcctgacccaggggaagaagatgatccggccccagcccatggagcacaagtactcctggaagtcctggggcaaggccaagatcatcggcgccgacacccagaacacgaccttcatcatcgacgggcccgacaccccggagtgccccgacgaccagcgcgcctggaacatctgggaggtggaggactacggcttcgggatcttcaccacgaacatctggctgaagctccgggactcctacacccagatgtgcgaccaccgcctgatgagcgcggccatcaaggactccaaggccgtccacgccgacatgggctactggatcgagagcgagaagaacgagacctggaagctggcccgggcgtccttcatcgaggtgaagacctgcatctggccccgcagccacacgctctggtccaacggcgtgctggagagcgagatgatcatccccaagatctacgggggcccgatctcccagcacaactaccggcccgggtacttcacccagaccgccggcccctggcacctggggaagctcgagctggacttcgacctgtgcgagggcaccacggtcgtggtggacgagcactgcggcaaccgcgggccgagcctccggaccaccaccgtcacgggcaagatcatccacgagtggtgctgccgctcctgcaccctgccgcccctgcggttcaagggggaggacggctgctggtacgggatggagatccgccccgtgaaggagaaggaggagaacctcgtgcggagcatggtctccgccggcagcggcgaggtggacagcttctccctggggctgctctgcgtgagcatcatgatcgaggaggtcatgcgctcccggtggagccgcaagatgctgatgaccggcaccctggccgtgttcttcctcctgatcatggggcagctgacgtggaacgacctcatccgcctgtgcatcatggtgggcgccaacgtctccgaccggatggggatgggcaccacctacctggcgctcatggccaccttcaagatgcgcccgatgttcgccgtggggctgctgttccggcgcctcacgagccgggaggtgctgctgctcaccatcgggctgtccctggtcgccagcgtggagctccccaactccctggaggagctgggcgacgggctcgccatgggcatcatgatgctgaagctgctcaccgacttccagagccaccagctgtggaccacgctgctctccctgaccttcatcaagaccaccctgagcctcgactacgcgtggaagacgatcgccatggtcctgtccatcgtgagcctgttccccctctgcctgtccaccaccagccagaagaccacgtggctgcccgtgctcctgggctccttcgggtgcaagccgctgaccatgttcctcatcaccgagaacaagatctggggccgccggagctggcccctgaacgaggggatcatggccgtcggcatcgtgtccatcctgctcagcagcctgctgaagaacgacgtgcccctcgccgggcccctgatcgcgggcggcatgctgatcgcctgctacgtcatctccgggagctccgccgacctcagcctggagaaggccgccgaggtgtcctgggaggaggaggcggagcacagcggcgcctcccacaacatcctggtggaggtccaggacgacgggaccatgaagatcaaggacgaggagcgcgacgacaccctcacgatcctgctgaaggccaccctcctggccgtgagcggcgtgtacccgatgtccatccccgccaccctgttcgtctggtacttctggcagaagaagaagcagcggagcggggtgctctgggacacccccagcccgcccgaggtggagcgcgcggtcctggacgacggcatctaccggatcctgcagcgcggcctgctcgggcggagccaggtgggcgtgggggtcttccaggacggcgtgttccacacgatgtggcacgtgacccgcggggccgtcctgatgtaccagggcaagcggctggagccctcctgggccagcgtgaagaaggacctcatctcctacggcgggggctggcgcttccaggggagctggaacaccggcgaggaggtgcaggtcatcgccgtggagcccgggaagaaccccaagaacgtgcagaccacgcccggcaccttcaagacccccgagggcgaggtcggggccatcgcgctggacttcaagcccggcacctccgggagccccatcgtgaaccgggagggcaagatcgtgggcctgtacgggaacggcgtcgtgacgacctccgggacctacgtgagcgccatcgcccaggccaaggccagccaggagggcccgctccccgagatcgaggacgaggtcttcaagaagcgcaacctgaccatcatggacctgcaccccgggtccggcaagacgcggcgctacctcccggcgatcgtgcgggaggccatcaagcgcaagctgcgcaccctgatcctcgcccccacccgggtggtcgccagcgagatggcggaggccctgaagggcatgcccatccgctaccagaccacggccgtgaagtccgagcacaccgggcgggagatcgtggacctgatgtgccacgccaccttcaccatgcgcctcctgagccccgtccgggtgccgaactacaacatgatcatcatggacgaggcccacttcacggaccccgcgtccatcgccgcccgcggctacatcagcacccgggtggggatgggcgaggccgccgcgatcttcatgaccgccacgccgcccgggtccgtcgaggccttcccgcagagcaacgccgtgatccaggacgaggagcgcgacatccccgagcggtcctggaacagcggctacgactggatcacggacttccccggcaagaccgtgtggttcgtcccctccatcaagagcgggaacgacatcgccaactgcctgcgcaagaacggcaagcgggtgatccagctctcccgcaagaccttcgacaccgagtaccagaagacgaagaacaacgactgggactacgtggtcaccaccgacatcagcgagatgggggcgaacttccgggccgaccgcgtgatcgacccgcggcgctgcctgaagcccgtgatcctgaaggacggccccgagcgggtcatcctcgccgggcccatgccggtgaccgtcgcctccgcggcccagcgccggggccgcatcggccgcaaccagaacaaggagggggaccagtacatctacatgggccagcccctgaacaacgacgaggaccacgcccactggacggaggccaagatgctgctcgacaacatcaacacccccgaggggatcatccccgccctgttcgagccggagcgggagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacgtacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagaccctgatgctcctggccctgatcgccgtgctcaccgggggcgtcacgctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagacgaccaagaaggacctcggcatcgggcacgtggtcgccgagaaccaccaccacgccaccatgctggacatcgacctgcaccccgcctccgcgtggaccctctacgccgtggccacgaccatcatcaccccgatgatgcggcacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggccgcggtgctcatgctggtggcccactacgccatcatcgggccgggcctgcaggccaaggcgacccgcgaggcccagaagcgcaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcggaccacctgggccctgtgcgagagcatcaccctggccacggggcccctcaccaccctgtgggagggctccccggggaagttctggaacaccacgatcgccgtgagcatggccaacatcttccgcggctcctacctggcgggcgccgggctcgccttcagcctgatgaagtccctgggcgggggccggcgcgggaccggcgcccagggcgagaccctcggggagaagtggaagcggcagctgaaccagctgagcaagagcgagttcaacacctacaagcgctccggcatcatggaggtggaccggagcgaggccaaggaggggctcaagcgcggcgagacgaccaagcacgcggtctcccgggggaccgccaagctgcgctggttcgtggagcggaacctggtgcgccccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgtactccgggaaggacgtgttcttcacgccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacgtcccgcatgctcctgaaccgcttcaccatggcccaccggaagcccacctacgagcgcgacgtggacctgggcgccggcacccggcacgtggccgtcgagcccgagatcgccaacctcgacatcatcgggcagcgcatcgagaacatcaagaacgagcacaagagcacgtggcactacgacgaggacaacccctacaagacctgggcgtaccacggctcctacgaggtgaagccgagcgggtccgccagctccatggtgaacggcgtcgtgcggctgctgaccaagccctgggacgtcatccccatggtgacccagatcgccatgacggacaccacccccttcgggcagcagcgcgtgttcaaggagaaggtcgacacccggacgccgcgccccaagcggggcaccgcccagatcatggaggtgaccgccaagtggctctggggcttcctgagccgcaacaagaagccccggatctgcacccgcgaggagttcacgcggaaggtgcgcagcaacgcggccatcggggccgtcttcgtggacgagaaccagtggaactccgccaaggaggccgtggaggacgagaagttctgggacctggtccaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatcccgggcggcaacatgtacgccgacgacaccgccgggtgggacacccgcatcacggaggacgacctccagaacgaggccaagatcaccgacatcatggagcccgagcacgccctgctggcgacctccatcttcaagctcacctaccagaacaaggtcgtgcgcgtgcagcggcccgccaagagcggcacggtcatggacgtgatctcccgccgggaccagcgcgggagcggccaggtgggcacctacgggctgaacaccttcaccaacatggaggtccagctgatccggcagatggagtccgagggcatcttcagcccctccgagctcgagaacagcaacctggccgagcgcgtgctggactggctcgagaagcacggggtggagcggctgaagcgcatggccatctccggcgacgactgcgtcgtgaagccgacggacgaccggttcgccaccgcgctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtggtgccgtgccgcaaccaggacgagctggtcgggcgggcccgcgtgagccagggcgccgggtggagcctccgggagaccgcctgcctgggcaagtcctacgcgcagatgtggcagctgatgtacttccaccgccgggacctccgcctggccgccaacgccatctgcagcgccgtgcccgtcgactgggtgcccacgtcccggaccacctggagcatccacgcgcaccaccagtggatgaccaccgaggacatgctgtccgtgtggaaccgcgtctggatcgaggagaacccctggatggaggacaagacgcacgtgagctcctgggaggacgtgccgtacctcgggaagcgcgaggaccagtggtgcggcagcctgatcggcctgaccgcccgggccacctgggccaccaacatccaggtcgcgatcaaccaggtgcgccggctcatcgggaacgagaactacctggactacatgacgtccatgaagcgcttcaagaacgagagcgaccccgagggcgccctgtggtga

SEQ ID NO: 8854 - RNA, 9879 nt, synthetic construct
  misc_feature 1..9879: note = derived and/or modified CDS sequence (opt1) from DENV-1__KP406802__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcggggatcaacatgtgcaccctcatcgccatggacctgggcgagctgtgcgaggacaccctcacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtggagacctgggccctgcgccaccccgggttcacggtcatcgccctgttcctcgcgcacgccatcggcaccagcatcacccagaaggggatcatcttcatcctgctgatgctcgtgaccccctccatggccatgcggtgcgtgggcatcggcagccgcgacttcgtcgaggggctgtccggcgccacgtgggtggacgtggtcctggagcacgggagctgcgtgaccaccatggccaaggacaagcccaccctcgacatcgagctgctgaagacggaggtgaccaaccccgcggtcctccggaagctgtgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctgatcacgtgcgccaagttcaagtgcgtgaccaagctggagggcaagatcgtgcagtacgagaacctcaagtacagcgtcatcgtgaccgtgcacaccggcgaccagcaccaggtcgggaacgagtccacggagcacggcaccaccgcgaccatcacgccccaggcccccacgaccgagatccagctgaccgactacggggccctgaccctcgactgcagcccccgcacgggcctggacttcaacgagatggtgctgctcaccatgaaggagaagtcctggctggtccacaagcagtggttcctggacctccccctgccctggaccagcggggccagcacctcccaggagatctggaaccggcaggacctgctcgtgacgttcaagaccgcccacgcgaagaagcaggaggtggtcgtgctgggcagccaggagggcgccatgcacaccgccctgaccggggccacggagatccagacctccggcaccaccacgatcttcgccgggcacctcaagtgccgcctgaagatggacaagctgaccctcaagggcatgagctacgtgatgtgcaccgggtccttcaagctggagaaggaggtcgcggagacccagcacggcacggtgctggtgcagatcaagtacgagggcaccgacgccccctgcaagatccccttcagcacccaggacgagaagggggtcacccagaacggccggctgatcacggccaacccgatcgtgaccgacaaggagaagcccgtgaacatcgaggccgagccgcccttcggggagtcctacatcgtcatcggcgcgggcgagaaggccctcaagctgagctggttcaagaaggggtccagcatcggcaagatgttcgaggccaccgcccgcggggcccggcgcatggcgatcctgggcgacaccgcctgggacttcgggtccatcggcggcgtgttcacgagcgtggggaagctcgtccaccagatcttcggcaccgcctacggggtgctgttctccggcgtgagctggaccatgaagatcgggatcggcgtcctgctcacctggctgggcctgaactcccgcagcacgtccctcagcatgacctgcatcgccgtggggctggtgaccctgtacctcggcgtcatggtgcaggccgactccgggtgcgtgatcaactggaagggccgggagctgaagtgcgggagcggcatcttcgtcaccaacgaggtgcacacgtggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagcacaagtacagctggaagtcctggggcaaggccaagatcatcggcgccgacgtgcagaacaccacgttcatcatcgacgggcccaacaccccggagtgccccgacgaccagcgcgcgtggaacatctgggaggtggaggactacggcttcgggatcttcaccaccaacatctggctgaagctccgggacagctacacgcaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacaccctctggagcaacggcgtcctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcttcctcctgatcatggggcagctgacctggaacgacctcatccgcctgtgcatcatggtgggcgcgaacgccagcgaccgcatggggatgggcacgacctacctggccctcatggccaccttcaagatgcggccgatgttcgccgtcggcctgctgttccgccggctcacctcccgcgaggtgctgctgctcacgatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgaccttcatcaagacgaccttctccctgcactacgcctggaagaccatggcgatggtgctcagcatcgtctccctgttccccctgtgcctcagcaccacgtcccagaagaccacctggctgcccgtgctgctcggcagcctggggtgcaagccgctgaccatgttcctcatcgccgagaacaagatctggggccggaagtcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggacgatgaagatcaaggacgaggagcgcgacgacaccctcaccatcctgctgaaggccaccctcctggccgtctccggcgtgtacccgctgagcatccccgccaccctcttcgtgtggtacttctggcagaagaagaagcagcggtccggggtcctgtgggacacgcccagcccgcccgaggtggagcgcgccgtgctggacgacggcatctaccggatcatgcagcgcggcctgctcgggcggtcccaggtcggcgtgggggtgttccaggagaacgtcttccacaccatgtggcacgtgacccgcggcgcggtgctgatgtaccaggggaagcggctggagcccagctgggcctccgtcaagaaggacctcatcagctacggcggcgggtggcgcctgcagggctcctggaacaccggggaggaggtccaggtgatcgccgtcgagcccggcaagaaccccaagaacgtgcagacggcccccgggaccttcaagacccccgagggcgaggtgggcgccatcgcgctggacttcaagcccgggaccagcggctcccccatcgtcaaccgggaggggaagatcgtgggcctctacggcaacggggtggtcacgaccagcggcacctacgtgagcgccatcgcccaggccaaggcgtcccaggaggggccgctgcccgagatcgaggacgaggtgttccgcaagcggaacctgaccatcatggacctccaccccggcagcgggaagacgcgccggtacctgccggccatcgtccgcgaggccatcaagcggaagctgcgcaccctcatcctggcccccacccgcgtggtggcctccgagatggcggaggccctgaagggcatgcccatccggtaccagaccacggccgtcaagagcgagcacaccggcaaggagatcgtggacctcatgtgccacgccaccttcaccatgcgcctgctgtcccccgtgcgggtcccgaactacaacatgatcatcatggacgaggcccacttcacggaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgccaactgcctccgcaagaacgggaagcgggtcatccagctgtcccgcaagaccttcgacaccgagtaccagaagacgaagaacaacgactgggactacgtggtgaccaccgacatcagcgagatgggcgcgaacttccgggccgaccgcgtcatcgacccgcggcgctgcctgaagcccgtgatcctcaaggacgggcccgagcgggtgatcctggccggccccatgccggtcaccgtggcctccgccgcgcagcgccgggggcgcgtcggccggaaccacaacaaggagggcgaccagtacatctacatggggcagcccctgaacaacgacgaggaccacgcccactggacggaggccaagatgctcctggacaacatcaacacccccgagggcatcatccccgccctgttcgagccggagcgcgagaagtccgccgcgatcgacggggagtaccgcctccggggcgaggcccgcaagaccttcgtggagctgatgcggcgcggggacctgcccgtgtggctctcctacaaggtcgccagcgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacgtactccgaccccctggccctgcgcgagttcaaggagttcgcggccggccggcgcagcgtctccggggacctcatcctggagatcggcaagctgccgcagcacctcacccagcgggcccagaacgccctggacaacctggtgatgctccacaacagcgagcagggcgggcgcgcgtaccggcacgccatggaggagctgcccgacaccatcgagaccctgatgctcctggccctgatcgccgtgctcacgggcggggtcaccctgttcttcctgtccggccgcgggctcggcaagaccagcatcggcctgctgtgcgtgatggcctccagcgtgctcctgtggatggcgtccgtcgagccccactggatcgccgccagcatcatcctggagttcttcctcatggtgctgctgatccccgagccggaccggcagcgcacgccccaggacaaccagctcgcctacgtggtcatcgggctgctgttcatgatcctcaccgtggccgcgaacgagatgggcctgctggagacgaccaagaaggacctcgggatcggccacgtggccgtcgagaaccaccaccacgccgccatgctggacgtggacctgcaccccgcctccgcgtggaccctctacgccgtggccaccacgatcatcaccccgatgatgcggcacaccatcgagaacaccacggccaacatcagcctgaccgccatcgcgaaccaggccgccatcctgatggggctcgacaagggctggcccatctccaagatggacatcggcgtccccctgctggccctcgggtgctacagccaggtgaaccccctgaccctgaccgcggccgtgctcatgctggtcgcccactacgccatcatcggcccggggctgcaggccaaggcgacgcgcgaggcccagaagcgcaccgccgccggcatcatgaagaaccccaccgtggacgggatcgtggccatcgacctcgaccccgtcgtgtacgacgcgaagttcgagaagcagctgggccagatcatgctgctcatcctgtgcacctcccagatcctgctcatgcggacgacctgggccctgtgcgagagcatcaccctggccaccggccccctcacgaccctgtgggaggggtccccgggcaagttctggaacaccaccatcgccgtgagcatggccaacatcttccgcgggtcctacctggcgggcgccggcctcgccttcagcctgatgaagtccctcgggggcgggcggcgcgggacgggggcccagggcgagaccctcggcgagaagtggaagcggcagctgaaccagctgtccaagagcgagttcaacacctacaagcgctccgggatcatggaggtcgaccggagcgaggcgaaggagggcctcaagcgcggggagaccacgaagcacgccgtgtcccggggcaccgccaagctgcgctggttcgtggagcggaacctggtcaagcccgaggggaaggtgatcgacctgggctgcggccgcgggggctggagctactactgcgccgggctcaagaaggtgaccgaggtcaagggctacaccaagggcgggcccggccacgaggagcccatcccgatggccacgtacgggtggaacctggtgaagctgcactccggcaaggacgtgttcttcatcccgcccgagaagtgcgacaccctcctgtgcgacatcggggagagctcccccaacccgaccatcgaggagggccggaccctgcgcgtcctcaagatggtggagccctggctgcgggggaaccagttctgcatcaagatcctgaacccctacatgcccagcgtggtcgagacgctcgagcagatgcagcgcaagcacggcggcatgctggtgcggaacccgctgtcccgcaacagcacccacgagatgtactgggtgtcctgcgggaccggcaacatcgtcagcgcggtgaacatgacctcccggatgctcctgaaccgcttcaccatggcccaccgcaagcccacgtacgagcgggacgtggacctgggggccggcacccgccacgtcgccgtggagcccgaggtggccaacctcgacatcatcggccagcggatcgagaacatcaagcacgagcacaagagcacctggcactacgacgaggacaacccctacaagacctgggcgtaccacgggtcctacgaggtcaagccgagcggctccgccagcagcatggtgaacggggtcgtgaagctgctgacgaagccctgggacgtgatccccatggtcacccagatcgccatgaccgacaccacgcccttcggccagcagcgcgtgttcaaggagaaggtggacacccggaccccgaaggccaagcgcgggaccacgcagatcatggaggtcaccgcccggtggctctggggcttcctgtcccgcaacaagaagccccggatctgcacccgcgaggagttcacccggaaggtgcgcagcaacgcggccatcggcgccgtgttcgtcgacgagaaccagtggaactccgccaaggaggcggtggaggacgagcggttctgggacctggtgcaccgcgagcgggagctccacaagcaggggaagtgcgccacgtgcgtctacaacatgatgggcaagcgcgagaagaagctgggggagttcggcaaggccaaggggagccgggccatctggtacatgtggctgggcgcccgcttcctcgagttcgaggcgctgggcttcatgaacgaggaccactggttctcccgggagaacagcctgtccggggtggagggcgaggggctccacaagctgggctacatcctgcgcgacatcagcaagatccccgggggcaacatgtacgccgacgacaccgccggctgggacacccggatcaccgaggacgacctccagaacgaggccaagatcacggacatcatggagccggagcacgccctgctggcgaaggccatcttcaagctcacctaccagaacaaggtggtccgcgtgcagcgccccgccaagaacgggaccgtgatggacgtcatctcccggcgcgaccagcggggcagcggccaggtggggacctacggcctgaacacgttcaccaacatggaggcccagctgatccgccagatggagtccgaggggatcttcagcccctccgagctcgagacccccaacctggccgagcgggtgctggactggctcgagaagtacggcgtcgagcgcctgaagcggatggcgatcagcggggacgactgcgtggtgaagccgatcgacgaccgcttcgccaccgccctgacggccctcaacgacatgggcaaggtccggaaggacatcccccagtgggagccctccaaggggtggaacgactggcagcaggtccccttctgcagccaccacttccaccagctgatcatgaaggacggccgcgagatcgtggtcccgtgccggaaccaggacgagctggtgggccgcgcccgggtgtcccagggggcgggctggagcctccgcgagaccgcctgcctgggcaagagctacgcccagatgtggcagctgatgtacttccaccggcgcgacctccggctggccgcgaacgccatctgctccgccgtccccgtggactgggtgcccaccagccgcaccacgtggtccatccacgcccaccaccagtggatgaccaccgaggacatgctgagcgtctggaaccgggtgtggatcgaggagaacccctggatggaggacaagacccacatctccagctgggaggacgtgccgtacctcggcaagcgcgaggaccagtggtgcgggtccctgatcggcctgacggcccgcgcgacctgggccaccaacatccaggtcgccatcaaccaggtgcggcgcctcatcggcaacgagaactacctggactacatgaccagcatgaagcggttcaagaacgagtccgaccccgagggggccctgtggtga

SEQ ID NO: 8855 - RNA, 9879 nt, synthetic construct
  misc_feature 1..9879: note = derived and/or modified CDS sequence (opt1) from DENV-1__KP406803__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgccggggtgaacatgtgcaccctgatcgccatggacctgggcgagctctgcgaggacaccatgacctacaagtgcccccggatcaccgagaccgagcccgacgacgtggactgctggtgcaacgccaccgagacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcggcctgttcggcaaggggagcctgatcacgtgcgccaagttcaagtgcgtgaccaagctggagggcaagatcgtccagtacgagaacctcaagtactccgtgatcgtgacggtccacaccggcgaccagcaccaggtggggaacgagaccaccgagcacggcaccacggccaccatcacgccccaggcccccaccagcgagatccagctgacggactacggggcgctgaccctcgactgcagcccccggaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcccacgccaagaagcaggaggtcgtggtgctgggctcccaggagggcgccatgcacaccgcgctgaccggggccaccgagatccagacgagcggcaccaccaccatcttcgccgggcacctcaagtgccgcctgaagatggacaagctgacgctcaagggcgtctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctgatcaccgcgaacccgatcgtgaccgacaaggagaagcccgtgaacatcgaggccgagccgcccttcggggagtcctacctcgtcgtgggcgccggcgagaaggccctgaagctgagctggttcaagaaggggtccagcatcggcaagatgttcgaggcgacggcccgcggggcccggcgcatggccatcctcggcgacaccgcctgggacttcgggtccatcggcggcgtgttcaccagcgtcgggaagctgatccaccagatcttcggcaccgcgtacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctgtccgccgcgatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtgaacggcatcctggcccaggggaagaagatgatccggccccagcccatggagcacaagtacagctggaagtcctggggcaaggccaaggtcatcggcgcggacgtgcagaacatcaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgccgccatcaaggacagcaaggcggtgcacgccgacatgggctactggatcgagtccgagaagaacgagacctggaagctgacccgggccagcttcatcgaggtgaagacgtgcgtctggcccaagtcccacaccctctggagcaacggcgtgctggagtccgagatgatcatccccaagatctacgggggcccgatcagccagcacaactaccgccccgggtacttcacccagaccgccggcccctggcacctggggaagctcgagctggacttcggcctgtgcgagggcacgaccgtggtcgtggacgagcactgcgggaaccggggcccgtccctccgcaccaccacggtgaccgggaagatcatccacgagtggtgctgccggagctgcaccctgccgcccctgcgcttcaagggcgaggacgggtgctggtacggcatggagatccggcccgtcaaggagaaggaggagaacctcgtgaagtccatggtgagcgccggcagcggggaggtcgactccttcagcctgggcctgctctgcatctccatcatgatcgaggaggtgatgcgcagccggtggtcccgcaagatgctgatgaccgggacgctggcggtgttcctcctgctgatcatgggccagctcacctggaacgacctgatccggctgtgcatcatggtcggggccaacgccagcgacaagatgggcatgggcaccacctacctcgccctgatggccacgttccgcatgcgcccgatgttcgcggtggggctcctcttccggcgcctgacctcccgggaggtcctgctcctgaccgtgggcctgagcctcgtggcctccgtcgagctgcccaacagcctggaggagctcggggacggcctggccatgggcatcatgatgctgaagctcctgaccgacttccagtcccaccagctgtgggccgccctcctgagcctgacgttcgtgaagaccaccttctccctccactacgcgtggaagaccatggccatgatcctgagcatcgtgtccctgttccccctctgcctgagcacgacctcccagaagaccacctggctgcccgtcctcctggggagcctgggctgcaagccgctcacgatgttcctgatcaccgagaacaagatctgggggcgcaagtcctggcccctgaacgagggcatcatggccgtggggatcgtgagcatcctcctgagctccctgctcaagaacgacgtccccctggccggccccctgatcgcgggcgggatgctcatcgcctgctacgtgatcagcggctccagcgccgacctgtccctggagaaggccgccgaggtgagctgggaggaggaggcggagcactccggggccagccacaacatcctcgtcgaggtgcaggacgacggcaccatgaagatcaaggacgaggagcgggacgacaccctgaccatcctgctcaaggccacgctgctggccatctccggggtgtacccgatgagcatccccgccaccctcttcgtctggtacttctggcagaagaagaagcagcgctccggcgtgctgtgggacacccccagcccgcccgaggtggagcgggcggtcctggacgacggcatctaccgcatcctgcagcgggggctcctgggcaagtcccaggtgggggtgggcgtcttccaggagggggtgttccacaccatgtggcacgtgacgcgcggcgccgtcctgatgtaccagggcaagcggctcgagcccagctgggcctccgtgaagaaggacctgatcagctacgggggcgggtggcgcttccagggctcctggaacaccggggaggaggtgcaggtcatcgccgtggagcccggcaagaaccccaagaacgtgcagaccgcccccggcaccttcaagacgcccgagggggaggtcggcgcgatcgccctggacttcaagcccgggaccagcggctcccccatcgtgaaccgggagggcaagatcgtggggctctacggcaacggggtcgtgaccaccagcggcacgtacgtgagcgccatcgcccaggccaaggcgtcccaggaggggccgctgcccgagatcgaggacgaggtcttccgcaagcggaacctgaccatcatggacctccaccccggcagcggcaagacccgccggtacctgccggccatcgtgcgcgaggccatcaagcggaagctgcgcaccctcgtgctggcccccacgcgggtcgtggcgtccgagatggccgaggccctgaaggggatccccatccgctaccagaccaccgccgtcaagagcgagcacaccggcaaggagatcgtcgacctcatgtgccacgccacgttcaccatgcgcctgctgtcccccgtgcgggtgccgaactacaacatgatcatcatggacgaggcgcacttcaccgaccccgccagcatcgccgcccgcgggtacatctccacccgggtcggcatgggggaggccgcggccatcttcatgacggccacgccgcccggcagcatggaggccttcccgcagtccaacgccgcgatccaggacgaggagcgcgacatccccgagcggagctggaactccggctacgactggatcaccgacttccccgggaagaccgtgtggttcgtgcccagcatcaagtccggcaacgacatcgccaactgcctccgcaagaacgggaagcgggtcgtgcagctgagccgcaagacgttcgacaccgagtaccagaagaccaagaacaacgactgggactacgtggtcaccacggacatctccgagatgggcgccaacttccgggccgaccgcgtgatcgacccgcggcgctgcctgaagcccgtcatcctcaaggacgggcccgagcgggtgatcctggcgggccccatgccggtgaccgtcgccagcgccgcccagcgccggggccgcatcgggcggaaccagaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgcgagaagtccgccgccatcgacggggagtaccggctccgcggcgaggcccgcaagacgttcgtggagctgatgcggcgcggcgacctgcccgtgtggctcagctacaaggtcgcgtccgaggggttccagtacagcgaccggcgctggtgcttcgacggcgagcggaacaaccaggtgctggaggagaacatggacgtggagatctggaccaaggagggggagcgcaagaagctgcggccccgctggctcgacgcccggacctacagcgaccccctggccctgcgcgagttcaaggagttcgccgccggccggcgctccgtcagcggcgacctcatcctggagatcgggaagctgccgcagcacctcacccagcgggcgcagaacgccctggacaacctggtgatgctccacaactccgagcagggcgggaaggcctaccgccacgccatggaggagctgcccgacacgatcgagaccctgatgctcctggcgctgatcgccgtgctcaccggcggggtcaccctgttcttcctgagcggccggggcctcgggaagacctccatcggcctgctgtgcgtgatggccagctccgccctcctgtggatggccagcgtggagccccactggatcgcggcctccatcatcctggagttcttcctcatggtcctgctgatccccgagccggaccgccagcggacgccccaggacaaccagctcgcctacgtggtgatcgggctgctgttcatgatcctcaccgtcgccgccaacgagatgggcctgctggagaccaccaagaaggacctcgggatcggccacgtggcggccgagagccaccaccacgccgccatgctggacgtggacctgcaccccgcctccgcgtggacgctctacgccgtcgccaccaccatcatcaccccgatgatgcgccacacgatcgagaacaccaccgccaacatcagcctgaccgccatcgcgaaccaggccgccatcctgatgggcctcgacaaggggtggcccatctccaagatggacatcggcgtgcccctgctggccctcgggtgctacagccaggtgaaccccctgacgctgaccgcggccgtcctcatgctggtggcccactacgccatcatcggcccggggctgcaggccaaggcgacccgggaggcccagaagcgcaccgccgccggcatcatgaagaaccccacggtggacggcatcgtcgccatcgacctcgaccccgtggtgtacgacgcgaagttcgagaagcagctggggcagatcatgctgctcatcctgtgcacctcccagatcctgctcatgcggaccacctgggccctgtgcgagagcatcacgctggccaccggccccctcaccaccctgtgggaggggtccccgggcaagttctggaacacgaccatcgccgtcagcatggccaacatcttccgcggctcctacctggcgggggccggcctcgccttcagcctgatgaagtccctcgggggcgggcgccgggggaccggcgcccagggggagaccctcggcgagaagtggaagcgccagctgaaccagctgtccaagagcgagttcaacacgtacaagcggtccgggatcatcgaggtggaccgcagcgaggcgaaggagggcctcaagcgcggggagaccaccaagcacgccgtgtcccgcggcaccgccaagctgcggtggttcgtcgagcgcaacctggtgaagcccgagggcaaggtgatcgacctggggtgcggccgcggcgggtggagctactactgcgccgggctcaagaaggtcacggaggtgaaggggtacaccaagggcgggcccggccacgaggagcccatcccgatggccacctacgggtggaacctggtgaagctgtactccggcaaggacgtcttcttcacgccgcccgagaagtgcgacacgctcctgtgcgacatcggggagagctcccccaacccgaccatcgaggagggccgcaccctgcgggtgctccgcatggtggagccctggctgcggggcaaccagttctgcatcaaggtcctgaacccctacatgcccagcgtggtggagaccctcgagcagatgcagcgcaagcacgggggcatgctggtccggaacccgctgtcccgcaacagcacccacgagatgtactgggtgtcctgcgggacgggcaacatcgtgagcgcggtcaacatgacctcccggatgctcctgaaccgcttcaccatggcccaccggaagcccacctacgagcgcgacgtggacctgggcgccgggacgcgccacgtggccgtcgagcccgaggtggccaacctcgacatcatcggccagcggatcgagaacatcaagaacgagcacaagagcacctggcactacgacgaggacaacccctacaagacctgggcgtaccacgggtcctacgaggtcaagccgagcggctccgccagcagcatggtgaacggggtggtccgcctgctgaccaagccctgggacgtgatccccatggtgacgcagatcgccatgaccgacaccacccccttcggccagcagcgggtcttcaaggagaaggtggacacgcgcaccccgaaggccaagcggggcaccgcccagatcatggaggtgaccgcgcgctggctctgggggttcctgtcccggaacaagaagccccgcatctgcacgcgggaggagttcacccgcaaggtccggagcaacgccgccatcggcgccgtgttcgtggacgagaaccagtggaactccgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaagggcagccgcgccatctggtacatgtggctgggggcgcggttcctcgagttcgaggccctgggcttcatgaacgaggaccactggttctcccgcgagaacagcctgtccggggtcgagggcgaggggctccacaagctgggctacatcctgcgggacatcagcaagatccccggcgggaacatgtacgccgacgacaccgccggctgggacacgcgcatcaccgaggacgacctccagaacgaggccaagatcaccgacatcatggagccggagcacgcgctgctggccacctccatcttcaagctcacgtaccagaacaaggtggtgcgggtccagcgccccgccaagaacgggaccgtgatggacgtgatcagccgccgggaccagcgcggctccggccaggtcgggacctacggcctgaacaccttcacgaacatggaggcccagctgatccggcagatggagagcgaggggatcttcctcccctccgagctggagacccccaacctggccgagcgcgtgctcgactggctggagaagtacggcatcgagcggctgaagcgcatggcgatcagcggggacgactgcgtggtcaagccgatcgacgaccggttcgccaccgccctcaccgccctgaacgacatgggcaaggtgcgcaaggacatcccccagtgggagccctccaagggctggaacgactggcagcaggtccccttctgcagccaccacttccaccagctgatcatgaaggacgggcgggagatcgtcgtgccgtgccgcaaccaggacgagctcgtgggccgggcccgcgtctcccagggggcgggctggagcctgcgggagacggcctgcctgggcaagagctacgcccagatgtggcagctcatgtacttccaccgccgggacctgcgcctggccgcgaacgccatctgctccgccgtgcccgtggactgggtccccaccagccggaccacctggtccatccacgcccaccaccagtggatgacgaccgaggacatgctcagcgtgtggaaccgcgtgtggatcgaggagaacccctggatggaggacaagacccacgtctccagctgggaggacgtgccgtacctgggcaagcgggaggaccagtggtgcggctccctgatcgggctcaccgcccgcgcgacctgggccacgaacatccaggtggccatcaaccaggtccgccggctgatcggcaacgagaactacctggactacatgaccagcatgaagcgcttcaagaacgagtccgaccccgagggggccctctggtga

SEQ ID NO: 8856 - RNA, 9879 nt, synthetic construct
  misc_feature 1..9879: note = derived and/or modified CDS sequence (opt1) from DENV-1__KJ438293__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatgacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagatcagctggttcaagaaggggtccagcatcggcaagatgttcgaggccaccgcccgcggggcccggcgcatggcgatcctcggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctcctgacgtggctgggcctcaactcccgcagcacctccctgagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctcaagctgcgggacagctacacccaggtctgcgaccaccgcctgatgtccgccgccatcaaggacagcaaggccgtgcacgccgacatgggctactggatcgagtccgagaagaacgagacctggaagctcgcgcgggccagcttcatcgaggtgaagacctgcatctggcccaagtcccacacgctgtggagcaacggcgtcctggagtccgagatgatcatccccaagatctacgggggcccgatcagccagcacaactaccgccccgggtacttcacccagaccgccggcccctggcacctcgggaagctggagctggacttcgacctctgcgagggcaccacggtggtggtcgacgagcactgcggcaaccgggggccgtccctgcgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctggtcaagtccatggtgagcgccggcagcggcgaggtggactccttcagcctggggctcctgtgcatctccatcatgatcgaggaggtcatgcggagccgctggtcccggaagatgctgatgaccggcaccctcgccgtgttcttcctgctgatcatggggcagctcacgtggaacgacctgatccgcctgtgcatcatggtgggcgcgaacgccagcgaccgcatggggatgggcaccacctacctcgccctgatggccaccttcaagatgcggccgatgttcgccgtcggcctcctgttccgccggctgacgtcccgcgaggtgctgctcctgaccatcgggctgagcctcgtggcgtccgtcgagctgcccaacagcctggaggagctcggcgacgggctggccatgggcatcatgatcctgaagctcctgaccggcttccagtcccaccagctgtgggccaccctcctgagcctgacgttcatcaagaccaccttctccctccactacgcctggaagaccatggcgatggtgctgagcatcgtctccctgttccccctctgcctgagcacgacctcccagaagaccacctggctgcccgtgctcctggggagcctgggctgcaagccgctcacgatgttcctgatcaccgagaacaagatctgggggcggaagtcctggcccctgaacgagggcatcatggccgtggggatcgtcagcatcctcctgagctccctgctcaagaacgacgtgcccctggccggccccctgatcgccggcgggatgctcatcgcctgctacgtgatcagcggctccagcgcggacctgtccctggagaaggccgccgaggtcagctgggaggaggaggccgagcactccggggccagccacaacatcctcgtggaggtgcaggacgacggcaccatgaagatcaaggacgaggagcgcgacgacaccctgaccatcctgctcaaggcgacgctgctggccgtctccggggtgtacccgctcagcatccccgccaccctgttcgtgtggtacttctggcagaagaagaagcagcggtccggcgtcctgtgggacacccccagcccgcccgaggtggagcgcgccgtgctcgacgacggcatctaccggatcatgcagcgcgggctgctgggccggtcccaggtcggggtgggcgtgttccaggagaacgtcttccacaccatgtggcacgtgacgcgcggggccgtgctgatgtaccagggcaagcggctcgagcccagctgggcgtccgtcaagaaggacctgatcagctacggcgggggctggcgcctgcaggggtcctggaacaccggcgaggaggtccaggtgatcgccgtcgagcccgggaagaaccccaagaacgtgcagaccgcccccggcaccttcaagacgcccgagggcgaggtgggggccatcgccctcgacttcaagcccggcaccagcgggtcccccatcgtcaaccgggagggcaagatcgtgggcctgtacgggaacggcgtggtcaccaccagcgggacgtacgtgagcgcgatcgcccaggccaaggcctcccaggagggcccgctgcccgagatcgaggacgaggtgttccgcaagcggaacctcaccatcatggacctgcaccccgggagcggcaagacccgccggtacctgccggcgatcgtccgcgaggccatcaagcggaagctccgcaccctgatcctggcccccacgcgcgtggtggcctccgagatggccgaggcgctcaagggcatgcccatccggtaccagaccaccgccgtcaagagcgagcacaccgggaaggagatcgtggacctgatgtgccacgccacgttcaccatgcgcctgctctcccccgtgcgggtcccgaactacaacatgatcatcatggacgaggcccacttcaccgaccccagctccatcgccgcgcgcggctacatcagcacccgggtggggatgggcgaggccgccgccatcttcatgacggccacgccgcccgggtccgtggaggcgttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctgtcccgcaagacgttcgacaccgagtaccagaagaccaagaacaacgactgggactacgtggtgaccacggacatcagcgagatgggggccaacttccgggcggaccgcgtcatcgacccgcggcgctgcctcaagcccgtgatcctgaaggacggccccgagcgggtggtcctggccgggcccatgccggtgaccgtcgcctccgccgcccagcgccggggccgcatcggccggaaccacaacaaggagggggaccagtacatctacatgggccagcccctcaacaacgacgaggaccacgcgcactggaccgaggccaagatgctgctggacaacatcaacacccccgaggggatcatccccgccctcttcgagccggagcgcgagaagtccgccgccatcgacggcgagtaccgcctgcgcggggaggcgcgcaagacgttcgtggagctgatgcggcgcggcgacctccccgtgtggctgtcctacaaggtcgccagcgagggcttccagtacagcgaccggcgctggtgcttcgacggggagcggaacaaccaggtgctggaggagaacatggacgtggagatctggaccaaggagggcgagcgcaagaagctccggccccgctggctggacgcccggacctactccgaccccctggccctccgcgagttcaaggagttcgccgcggggcggcgcagcgtctccggcgacctgatcctggagatcggcaagctcccgcagcacctgacccagcgggcccagaacgccctggacaacctcgtgatgctgcacaacagcgagcagggcgggcgcgcctaccggcacgcgatggaggagctgcccgacacgatcgagaccctcatgctgctggccctcatcgccgtgctgaccgggggcgtcaccctgttcttcctctccgggcgcggcctgggcaagaccagcatcgggctgctctgcgtgatggcctccagcgtgctgctgtggatcgcctccgtcgagccccactggatcgcggccagcatcatcctcgagttcttcctgatggtgctgctcatccccgagccggaccggcagcgcacgccccaggacaaccagctggcctacgtggtcatcggcctcctcttcatgatcctgaccgtggccgccaacgagatggggctgctcgagaccaccaagaaggacctgggcatcgggcacgtggcggtcgagaaccaccaccacgccgccatcctggacgtggacctccaccccgcctccgcctggacgctgtacgcggtggccaccaccatcatcaccccgatgatgcggcacacgatcgagaacaccaccgccaacatcagcctgaccgccatcgccaaccaggcggccatcctcatgggcctggacaagggctggcccatctccaagatggacatcggggtccccctgctcgccctgggctgctacagccaggtgaaccccctgacgctcaccgccgcggtgctgatgctggtcgcccactacgccatcatcgggccgggcctccaggccaaggccacccgcgaggcgcagaagcgcaccgccgccgggatcatgaagaaccccacggtggacggcatcgtggccatcgacctggaccccgtcgtgtacgacgccaagttcgagaagcagctgggccagatcatgctcctgatcctgtgcacctcccagatcctcctgatgcggaccacctgggcgctgtgcgagagcatcacgctcgccaccgggcccctgaccaccctgtgggagggctccccggggaagttctggaacacgaccatcgccgtgagcatggccaacatcttccgcggctcctacctcgccggcgcggggctggccttcagcctgatgaagtccctcggcgggggccggcgcgggaccggcgcccagggcgagaccctgggggagaagtggaagcggcagctgaaccagctctccaagagcgagttcaacacgtacaagcgctccggcatcatggaggtcgaccggagcgaggccaaggaggggctgaagcgcggcgagaccaccaagcacgcggtgtcccgggggaccgccaagctgcgctggttcgtggagcggaacctcgtcaagcccgagggcaaggtgatcgacctgggctgcgggcgcggcgggtggagctactactgcgccggcctgaagaaggtgacggaggtcaaggggtacaccaagggcggccccgggcacgaggagcccatcccgatggccacctacggctggaacctggtgaagctctactccgggaaggacgtgttcttcatcccgcccgagaagtgcgacaccctgctgtgcgacatcggcgagagctcccccaacccgacgatcgaggaggggcggaccctccgcgtcctgaagatggtggagccctggctgcggggcaaccagttctgcatcaagatcctcaacccctacatgcccagcgtggtcgagaccctggagcagatgcagcgcaagcacggcgggatgctggtgcggaacccgctctcccgcaacagcacccacgagatgtactggatctcctgcggcaccgggaacatcgtgagcgccgtcaacatgacgtcccggatgctgctgaaccgcttcaccatggcgcaccgcaagcccacctacgagcgggacgtggacctcggcgccggcacccgccacgtggccgtcgagcccgaggtggccaacctggacatcatcgggcagcggatcgagaacatcaagcacgagcacaagagcacgtggcactacgacgaggacaacccctacaagacctgggcctaccacggctcctacgaggtgaagccgagcgggtccgcgagcagcatggtcaacggcgtggtcaagctgctcaccaagccctgggacgtgatccccatggtgacccagatcgccatgacggacaccacccccttcgggcagcagcgcgtcttcaaggagaaggtggacacccggacgccgaaggccaagcgcggcaccgcccagatcatggaggtgaccgcccggtggctgtggggcttcctgtcccgcaacaagaagccccggatctgcacccgcgaggagttcacgcggaaggtccgcagcaacgcggccatcggggccgtgttcgtggacgagaaccagtggaactccgccaaggaggcggtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggcagccgggccatctggtacatgtggctcggcgcccgcttcctggagttcgaggcgctggggttcatgaacgaggaccactggttctcccgggagaacagcctctccggcgtcgagggggagggcctgcacaagctggggtacatcctccgcgacatcagcaagatccccggcggcaacatgtacgccgacgacaccgccgggtgggacacccggatcacggaggacgacctgcagaacgaggccaagatcaccgacatcatggagccggagcacgccctgctcgcgaaggccatcttcaagctgacctaccagaacaaggtggtgcgcgtccagcgccccgccaagaacggcaccgtgatggacgtgatctcccggcgcgaccagcgggggagcggccaggtcggcacgtacgggctgaacaccttcaccaacatggaggcccagctcatccgccagatggagtccgagggcatcttcagcccctccgagctggagacccccaacctggccgagcgggtgctcgactggctggagaagtacggggtggagcgcctgaagcggatggcgatcagcggcgacgactgcgtcgtgaagccgatcgacgaccgcttcgccacggccctcaccgccctgaacgacatggggaaggtgcggaaggacatcccccagtgggagccctccaagggctggaacgactggcagcaggtccccttctgcagccaccacttccaccagctgatcatgaaggacggccgcgagatcgtggtgccgtgccggaaccaggacgagctcgtcgggcgcgcccgggtgtcccagggcgcggggtggagcctgcgcgagaccgcctgcctgggcaagagctacgcccagatgtggcagctcatgtacttccaccggcgcgacctgcggctggccgcgaacgccatctgctccgccgtgcccgtcgactgggtgcccaccagccgcacgacctggtccatccacgcccaccaccagtggatgaccaccgaggacatgctcagcgtgtggaaccgggtctggatcgaggagaacccctggatggaggacaagacgcacatctccagctgggaggacgtgccgtacctggggaagcgcgaggaccagtggtgcggctccctgatcggcctcaccgcccgcgcgacctgggccaccaacatccaggtggccatcaaccaggtccggcgcctgatcgggaacgagaactacctggactacatgaccagcatgaagcggttcaagaacgagtccgaccccgagggcgccctctggtga

SEQ ID NO: 8857 - RNA, 9879 nt, synthetic construct
  misc_feature 1..9879: note = derived and/or modified CDS sequence (opt1) from DENV-1__KJ438296__SS-prME
  source 1..9879: mol_type = other RNA
agcgtgaccatgctgctcatgctgatgcccaccgccctggccttccacctcaccacccggggcggggagccccacatgatggtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgatcggcaccctggccgtgttcttcctgctcatcatggggcagctgacctggaacgacctgatccgcctctgcatcatggtcggcgcgaacgccagcgaccgcatggggatgggcacgacctacctggccctgatggccaccttcaagatgcggccgatgttcgccgtgggcctcctgttccgccggctgacctcccgcgaggtgctcctgctgacgatcgggctcagcctggtcgcgtccgccgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcatccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgcgacgacaccctgaccatcctcctgaaggccaccctgctcgccgtctccggcgtgttcccgctgagcatccccgccaccctgttcgtgtggtacttctggcagaagaagaagcagcggtccggggtcctctgggacacgcccagcccgcccgaggtggagcgcgcggtgctggacgacggcatctaccggatcatgcagcgcggcctgctggggcggtcccaggtcggcgtgggggtgttccaggagaacgtcttccacaccatgtggcacgtgacccgcggcgccgtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgggaggggaagatcgtgggcctgtacggcaacggggtggtcacgaccagcggcacctacgtgagcgccatcgcccaggcgaaggcctcccaggaggggccgctccccgagatcgaggacgaggtgttccgcaagcggaacctgaccatcatggacctgcaccccggcagcgggaagacgcgccggtacctcccggccatcgtccgcgaggccatcaagcggaagctgcgcaccctgatcctcgcccccacccgcgtggtggcgtccgagatggccgaggccctgaagggcatgcccatccggtaccagaccacggccgtcaagagcgagcacaccggcaaggagatcgtggacctgatgtgccacgccaccttcaccatgcgcctcctgtcccccgtgcgggtcccgaactacaacatgatcatcatggacgaggcgcacttcacggaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgcgaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcaccgtggcctccgcggcccagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgcgctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgacgggcggggtgaccctcttcttcctgtccggccgcgggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgccatcatcggcccggggctgcaggcgaaggccacgcgcgaggcccagaagcgcaccgccgccggcatcatgaagaaccccaccgtcgacgggatcgtggcgatcgacctggaccccgtggtctacgacgccaagttcgagaagcagctcggccagatcatgctgctgatcctctgcacctcccagatcctgctgatgcggacgacctgggccctctgcgagagcatcaccctggccaccggccccctgacgaccctctgggaggggtccccgggcaagttctggaacaccaccatcgccgtgagcatggcgaacatcttccgcgggtcctacctggccggcgccggcctggccttcagcctcatgaagtccctcgggggcgggcggcgcgggacgggggcgcagggcgagaccctgggcgagaagtggaagcggcgcctcaaccagctgtccaagagcgagttcaacacctacaagcggtccgggatcatggaggtggaccgcagcgaggccaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggcgacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccggaacagcacccacgagatgtactgggtgtcctgcgggaccggcaacatcgtgagcgccgtcaacatgacctcccgcatgctgctcaaccgcttcaccatggcccaccggaagcccacgtacgagcgcgacgtggacctgggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcgcagatcatggaggtgacggcccgctggctgtggggcttcctctcccggaacaagaagccccgcatctgcacccgggaggagttcacccgcaaggtccggagcaacgccgccatcggcgcggtgttcatcgacgagaaccagtggaactccgccaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcgaagatcaccgacatcatggagccggagcacgccctcctggccaaggccatcttcaagctgacgtaccagaacaaggtcgtgcgcgtgcagcggcccgccaagaacgggaccgtcatggacgtgatctcccgccgggaccagcgcggcagcggccaggtggggacctacggcctcaacaccttcacgaacatggaggcgcagctgatccggcagatggagtccgaggggatcttcagcccctccgagctggagacccccaacctcgccgagcgcgtcctggactggctgggcaagtacggggtggagcggctcaagcgcatggccatcagcggcgacgactgcgtggtcaagccgatcgacgaccggttcgccaccgccctgaccgcgctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacatctccaactgggaggacgtcccgtacctggggaagcgcgaggaccagtggtgcggcagcctcatcggcctgaccgcccgggccacgtgggccaccaacatccaggtggccatcaaccaggtgcgccggctgatcgggaacgagaactacctcgactacatgacctccatgaagcgcttcaagaacgagagcgaccccgagggcgcgctgtggtga

SEQ ID NO: 8858 - RNA, 9879 nt, synthetic construct
  misc_feature 1..9879: note = derived and/or modified CDS sequence (opt1) from DENV-1__KC692495__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgcgacgctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgggagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcgcaacctcaccatcatggacctgcacccgggcagcggcaagacccggcgctacctgcccgccatcgtgcgggaggccatcaagcgcaagctccgcaccctgatcctggcccccacgcgggtcgtggcgtccgagatggccgaggccctcaaggggatgcccatccgctaccagaccaccgccgtcaagagcgagcacaccggccgggagatcgtcgacctgatgtgccacgccacgttcaccatgcgcctgctctccccggtgcgggtgcccaactacaacatgatcatcatggacgaggcgcacttcaccgaccccgccagcatcgccgcccgcgggtacatctccacccgggtcggcatgggggaggccgcggccatcttcatgacggccacgccgcccggcagcgtggaggccttcccccagtccaacgccgtgatccaggacgaggagcgcgacatccccgagcggagctggaactccggctacgactggatcaccgacttccccgggaagaccgtctggttcgtgcccagcatcaagtccggcaacgacatcgcgaactgcctgcgcaagaacgggaagcgggtgatccagctgagccgcaagacgttcgacaccgagtaccagaagaccaagaacaacgactgggactacgtcgtgaccacggacatctccgagatgggcgccaacttccgggccgaccgcgtgatcgacccccggcgctgcctcaagcccgtcatcctgaaggacgggcccgagcgggtgatcctggccggcccgatgcccgtcaccgtggcgagcgccgcccagcgccggggccgcatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagacgttcgtcgagctgatgcggcgcggcgacctccccgtgtggctgagctacaaggtggcctccgaggggttccagtacagcgaccggcgctggtgcttcgacggcgagcggaacaaccaggtcctggaggagaacatggacgtggagatctggaccaaggagggggagcgcaagaagctccggccccgctggctggacgcgcggacctactccgacccgctggccctccgcgagttcaaggagttcgccgccggccggcgcagcgtgagcggcgacctgatcctggagatcgggaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcggcacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcgcaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcggacgacctgggccctctgcgagtccatcaccctggcgaccggcccgctgacgaccctctgggaggggagccccggcaagttctggaacaccaccatcgccgtctccatggccaacatcttccgcggcagctacctggccggggccggcctggcgttctccctcatgaagtccctcgggggcgggcggcgcgggacgggcgcccagggggagaccctgggcgagaagtggaagcggcagctcaaccagctgtccaagagcgagttcaacacctacaagcgcagcgggatcatggaggtggaccggtccgaggccaaggagggcctgaagcgcggggagaccacgaagcacgccgtgagccggggcaccgcgaagctccgctggttcgtcgagcggaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccggaccctgcgcgtgctgaagatggtggagccctggctccggggcaaccagttctgcatcaagatcctgaacccctacatgccgtccgtcgtggagaccctggagcagatgcagcgcaagcacgggggcatgctcgtgcggaaccccctgagccgcaactccacgcacgagatgtactgggtcagctgcgggaccggcaacatcgtgtccgccgtgaacatgaccagccggatgctgctcaaccgcttcaccatggcccaccgcaagcccacgtacgagcgggacgtcgacctgggcgcggggacccgccacgtggccgtggagcccgaggtcgccaacctggacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtgcgcctcctgacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctgtgggggttcctctcccggaacaagaagccccgcatctgcacccgggaggagttcacccgcaaggtgcggagcaacgccgccatcggcgcggtcttcgtggacgagaaccagtggaacagcgccaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggcgaagggctcccgcgccatctggtacatgtggctgggggcccggttcctggagttcgaggccctcggcttcatgaacgaggaccactggttcagccgcgagaactccctgagcggggtggagggcgaggggctgcacaagctcggctacatcctgcgggacatctccaagatcccgggcgggaacatgtacgccgacgacaccgcgggctgggacacccgcatcaccgaggacgacctgcagaacgaggccaagatcacggacatcatggagcccgagcacgccctcctggccaccagcatcttcaagctgacctaccagaacaaggtcgtgcgcgtgcagcggcccgccaagaacgggaccgtcatggacgtgatctcccgccgggaccagcgcggcagcggccaggtggggacgtacggcctcaacaccttcaccaacatggaggtccagctgatccggcagatggagtccgaggggatcttcctgcccagcgagctcgagaccccgaacctggcggagcgcgccctggactggctcgagaagcacggcgccgagcggctgaagcgcatggccatctccggggacgactgcgtggtgaagcccatcgacgaccggttcgccacggcgctgaccgccctcaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctggtgggccgggcccgcgtgagccagggggccggctggtccctccgggagaccgcctgcctgggcaagagctacgcgcagatgtggcagctgatgtacttccaccgccgggacctccgcctggccgccaacgccatctgctccgcggtccccgtggactgggtgcccgccagccggaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcggcaagcgcgaggaccagtggtgcggcagcctgatcgggctgaccgcccgggccacgtgggcgaccaacatccaggtggccatcaaccaggtgcgccggctcatcggcaacgagaactacctggactacatgacctccatgaagcgcttcaagaacgagagcgaccccgagggggccctgtggtga

SEQ ID NO: 8859 - RNA, 9879 nt, synthetic construct
  misc_feature 1..9879: note = derived and/or modified CDS sequence (opt1) from DENV-1__KC692496__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgttcaagatgcgcccgatgttcgccgtggggctcctgttccggcgcctgaccagccgggaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtccccctggcgggcccgctcctggccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgcgacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtgcgcgaggccatcaagcgcaagctgcggaccctgatcctcgcccccacgcgcgtcgtggcgtccgagatggccgaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgccggcccgatgcccgtcaccgtggcgagcgccgcccagcggcgcggccgcatcgggcggaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtcatgctccacaactccgagcagggcgggaaggcctaccggcacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgccgcggagaaccaccagcacgccaccatgctggacgtggacctgcacccggccagcgcctggaccctctacgccgtggcgaccacggtcatcacccccatgatgcgccacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacgcgcgaggcccagaagcggaccgcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcgcacgacctgggccctgtgcgagtccatcaccctggcgaccggcccgctcacgaccctgtgggaggggagccccggcaagttctggaacaccaccatcgccgtctccatggccaacatcttccggggcagctacctggccggggccggcctcgcgttctccctgatgaagtccctcgggggcgggcgccgggggacgggcgcccagggggagaccctcggcgagaagtggaagcgccagctgaaccagctgtccaagagcgagttcaacacctacaagcggagcgggatcatggaggtggaccgctccgaggccaaggagggcctcaagcgcggggagaccacgaagcacgccgtgagccgcggcaccgcgaagctgcggtggttcgtcgagcgcaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccgcaccctgcgggtgctcaagatggtggagccctggctgcgcggcaaccagttctgcatcaagatcctgaacccctacatgccgtccgtcgtggagaccctcgagcagatgcagcggaagcacgggggcatgctggtgcgcaaccccctgagccggaactccacgcacgagatgtactgggtcagctgcgggaccggcaacatcgtgtccgccgtgaacatgaccagccgcatgctcctgaaccgcttcaccatggcccaccggaagcccacgtacgagcgcgacgtcgacctgggcgcggggacccggcacgtggccgtggagcccgaggtcgccaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctgctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctctgggggttcctgtcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtcgtgcgggtgcagcgccccgccaagaacgggaccgtcatggacgtgatctcccggcgcgaccagcggggcagcggccaggtggggacgtacggcctgaacaccttcaccaacatggaggtccagctgatccgccagatggagtccgaggggatcttcctccccagcgagctggagaccccgaacctggcggagcgggccctcgactggctggagaagcacggcgccgagcgcctgaagcggatggccatctccggggacgactgcgtggtgaagcccatcgacgaccgcttcgccacggcgctcaccgccctgaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtccccgtggactgggtgcccgccagccgcaccacctggagcatccacgcccaccaccagtggatgacgaccgaggacatgctctccgtctggaaccgcgtgtggatcgaggagaacccgtggatggaggacaagacccacgtgagctcctgggaggaggtcccctacctgggcaagcgggaggaccagtggtgcggcagcctgatcgggctcaccgcccgcgccacgtgggcgaccaacatccaggtggccatcaaccaggtgcggcgcctgatcggcaacgagaactacctggactacatgacctccatgaagcggttcaagaacgagagcgaccccgagggggccctctggtga

SEQ ID NO: 8860 - RNA, 9879 nt, synthetic construct
  misc_feature 1..9879: note = derived and/or modified CDS sequence (opt1) from DENV-1__KC692497__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagcgcgggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggggtgctggagagcgagatgatcatccccaagatcttcggcgggccgatctcccagcacaactaccggcccggctacttcacccagaccgccgggccctggcacctgggcaagctcgagctggacttcgacctgtgcgagggcacgaccgtggtcgtggacgagcactgcgggaaccgcggcccgagcctccggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcatcctgtgcgtgagcatcatgatcgaggaggtgatgcggtcccgctggagccgcaagatgctcatgaccgggacgctggccgtcttcctgctcctgatcatgggccagctgacctggaacgacctcatccggctgtgcatcatggtgggggccaacgcgtccgaccgcatgggcaccggcaccacgtacctggccctcatggccaccttcaagatgcggccgatgttcgccgtggggctgctgttccgccggctcaccagccgcgaggtcctgctgctcaccatcgggctgtccctggtggccagcgtcgagctccccaactccctggaggagctgggggacggcctcgcgatgggcatcatgatgctgaagctgctcacggagttccagccccaccagctgtggaccaccctgctcagcctgaccttcgtgaagacgaccctgtccctcgactacgcctggaagaccaccgccatggtgctgagcatcgtctccctgttccccctctgcctgagcacgacctcccagaagaccacctggctgccggtgctcctggggagcttcggctgcaagcccctgaccatgttcctcatcacggagaacaagatctgggggcggaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcaccatgaagatcaaggacgaggagcgcgacgacaccctcaccatcctgctgaaggccacgctcctggccgtgtccggggtctaccccatgagcatccccgcgaccctgttcgtgtggtacttctggcagaagaagaagcagcggtccggcgtgctctgggacacccccagcccgcccgaggtcgagcgcgccgtgctggacgacggcatctaccggatcctgcagcgcgggctgctcggccggtcccaggtgggggtcggcgtgttccaggacggggtgttccacaccatgtggcacgtcacgcgcggcgccgtgctgatgtaccagggcaagcggctggagcccagctgggcctccgtgaagaaggacctcatcagctacgggggcgggtggcgcttccagggctcctggaacaccggggaggaggtccaggtgatcgccgtggagcccggcaagaacccgaagaacgtccagaccacccccggcacgttcaagacccccgagggggaggtgggcgcgatcgccctggacttcaagcccgggaccagcggctccccgatcgtgaaccgggagggcaagatcgtcgggctgtacggcaacggggtggtgaccacgagcggcacctacgtctccgccatcgcccaggccaaggcgagccaggaggggcccctccccgagatcgaggacgaggtgttcaagaagcgcaacctgaccatcatggacctgcacccgggcagcggcaagacccggcgctacctccccgccatcgtgcgggaggccatcaagcgcaagctgcgcacgctgatcctcgcccccacccgggtcgtggcgtccgagatggccgaggccctgaaggggatgcccatccgctaccagaccaccgccgtcaagagcgagcacacgggccgggagatcgtcgacctgatgtgccacgccaccttcaccatgcgcctcctgtccccggtgcgggtgcccaactacaacatgatcatcatggacgaggcgcacttcaccgaccccgccagcatcgccgcccgcgggtacatctccacgcgggtcggcatgggggaggccgcggccatcttcatgaccgccacgccgcccggcagcgtggaggccttcccccagtccaacgccgtgatccaggacgaggagcgcgacatccccgagcggagctggaactccggctacgactggatcaccgacttccccgggaagacggtctggttcgtgcccagcatcaagtccggcaacgacatcgcgaactgcctgcgcaagaacgggaagcgggtgatccagctcagccgcaagaccttcgacaccgagtaccagaagaccaagaacaacgactgggactacgtcgtgacgaccgacatctccgagatgggcgccaacttccgggccgaccgcgtgatcgacccccggcgctgcctgaagcccgtcatcctgaaggacgggcccgagcgggtgatcctcgccggcccgatgcccgtcaccgtggcgagcgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacgcccgagggcatcatcccggcgctgttcgagcccgagcgggagaagtccgccgccatcgacggggagtaccgcctgcggggcgaggcccgcaagaccttcgtcgagctcatgcggcgcggcgacctgcccgtgtggctgagctacaaggtggcctccgaggggttccagtacagcgaccggcgctggtgcttcgacggcgagcggaacaaccaggtcctcgaggagaacatggacgtggagatctggaccaaggagggggagcgcaagaagctgcggccccgctggctggacgcgcggacctactccgacccgctcgccctgcgcgagttcaaggagttcgccgccggccggcgcagcgtgagcggcgacctgatcctcgagatcgggaagctgccccagcacctgaccctccgggcccagaacgcgctggacaacctggtcatgctccacaactccgagcagggcgggaaggcctaccgccacgccatggaggagctgcccgacacgatcgagaccctgatgctcctggccctgatcgcggtgctcaccggcggggtgaccctgttcttcctgagcggcaagggcctcgggaagacgtccatcggcctgctgtgcgtcaccgccagctccgccctcctgtggatggccagcgtggagccccactggatcgccgcgtccatcatcctggagttcttcctcatggtgctgctgatcccggagcccgaccggcagcgcacgccccaggacaaccagctcgcctacgtcgtgatcgggctgctgttcatgatcctcaccgtggccgccaacgagatgggcctgctggagacgaccaagaaggacctcgggatcggctacgtcgccgcggagaaccaccagcacgccaccatgctggacgtggacctgcacccggccagcgcctggaccctctacgccgtggcgacgaccgtcatcacccccatgatgcggcacaccatcgagaacacgaccgccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgacggccgccgtcctcatgctggtggcgcactacgccatcatcggccccgggctgcaggccaaggccacccgcgaggcccagaagcgcaccgcggccggcatcatgaagaaccccaccgtggacggcatcgtcgccatcgacctcgaccccgtggtgtacgacgccaagttcgagaagcagctggggcagatcatgctgctcatcctgtgcacgagccagatcctgctcatgcggaccacctgggccctgtgcgagtccatcaccctggcgacgggcccgctcaccaccctgtgggaggggagccccggcaagttctggaacaccacgatcgccgtctccatggccaacatcttccgcggcagctacctggccggggccggcctcgcgttctccctgatgaagtccctcgggggcgggcggcgcgggaccggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagacgaccaagcacgccgtgagccggggcaccgcgaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacgtacgggtggaacctggtgaagctgcacagcggcaaggacgtcttcttcatgccgcccgagaagtgcgacaccctcctgtgcgacatcggggagtccagcccgaaccccaccatcgaggagggccggaccctgcgcgtgctcaagatggtggagccctggctgcggggcaaccagttctgcatcaagatcctgaacccctacatgccgtccgtcgtggagacgctcgagcagatgcagcgcaagcacgggggcatgctggtgcggaaccccctgagccgcaactccacccacgagatgtactgggtcagctgcgggaccggcaacatcgtgtccgccgtgaacatgaccagccggatgctcctgaaccgcttcacgatggcccaccgcaagcccacctacgagcgggacgtcgacctgggcgcggggacccgccacgtggccgtggagcccgaggtcgccaacctcgacgtgatcggccagcggatcgagaacatcaagaacgagcacaagtccacctggcactacgacgaggacaacccgtacaagacgtgggcctaccacgggagctacgaggtcaagccctccggcagcgcctccagcatggtgaacggggtggtccgcctgctgaccaagccctgggacgtgatccccatggtgacccagatcgcgatgaccgacacgaccccgttcggccagcagcgggtcttcaaggagaaggtggacacccgcacgccccgggccaagcgcggcacgacccagatcatggaggtgaccgccaagtggctctgggggttcctgtcccggaacaagaagccccgcatctgcacccgggaggagttcacgcgcaaggtccggagcaacgccgccatcggcgcggtgttcgtggacgagaaccagtggaacagcgccaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgcgggctgggacacccgcatcacggaggacgacctccagaacgaggccaagatcaccgacatcatggagcccgagcacgccctgctggccaccagcatcttcaagctcacctaccagaacaaggtggtgcgcgtccagcggcccgccaagaacgggacggtgatggacgtgatctcccgccgggaccagcgcggcagcggccaggtcgggacctacggcctgaacaccttcaccaacatggaggtgcagctgatccggcagatggagtccgaggggatcttcctccccagcgagctggagacgccgaacctggcggagcgcgccctcgactggctggagaagcacggcgccgagcggctgaagcgcatggccatctccggggacgactgcgtggtcaagcccatcgacgaccggttcgccaccgcgctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctcgtgggccgggcccgcgtcagccagggggccggctggtccctgcgggagaccgcctgcctgggcaagagctacgcgcagatgtggcagctcatgtacttccaccgccgggacctgcgcctggccgccaacgccatctgctccgcggtgcccgtggactgggtccccgccagccggaccacgtggagcatccacgcccaccaccagtggatgaccaccgaggacatgctctccgtgtggaaccgcgtgtggatcgaggagaacccgtggatggaggacaagacccacgtcagctcctgggaggaggtgccctacctgggcaagcgcgaggaccagtggtgcggcagcctgatcgggctcacggcccgggccacctgggcgaccaacatccaggtggccatcaaccaggtccgccggctgatcggcaacgagaactacctggactacatgacctccatgaagcgcttcaagaacgagagcgaccccgagggggccctctggtga

SEQ ID NO: 8861 - RNA, 9879 nt, synthetic construct
  misc_feature 1..9879: note = derived and/or modified CDS sequence (opt1) from DENV-1__KC692498__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagcgcgggagctccatcggcaagatgttcgaggccaccgcccgcggggcccgccgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccggtccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatgaagttcaccgtcgtggtgggggacgccaacggcatcctggcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctctggtccaacggggtgctggagagcgagatgatcatccccaagatcttcggcgggccgatctcccagcacaactaccggcccggctacttcacccagaccgccgggccctggcacctgggcaagctcgagctggacttcgacctgtgcgagggcacgaccgtggtcgtggacgagcactgcgggaaccgcggcccgagcctccggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcatcctgtgcgtgagcatcatgatcgaggaggtgatgcggtcccgctggagccgcaagatgctcatgaccgggacgctggccgtcttcctgctcctgatcatgggccagctgacctggaacgacctcatccggctgtgcatcatggtgggggccaacgcgtccgaccgcatgggcaccggcaccacgtacctggccctcatggccaccttcaagatgcggccgatgttcgccgtggggctgctgttccgccggctcaccagccgcgaggtcctgctgctcaccatcggcctgtccctggtggccagcgtcgagctccccaactccctggaggagctgggggacggcctcgcgatgggcatcatgatgctgaagctgctcacggagttccagccccaccagctgtggaccaccctgctcagcctgaccttcgtgaagacgaccctgtccctcgactacgcctggaagaccaccgccatggtgctgagcatcgtctccctgttccccctctgcctgagcacgacctcccagaagaccacctggctgccggtgctcctggggagcttcggctgcaagcccctgaccatgttcctcatcacggagaacaagatctgggggcggaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcaccatgaagatcaaggacgaggagcgcgacgacaccctcaccatcctgctgaaggccacgctcctggccgtgtccggggtctaccccatgagcatccccgcgaccctgttcgtgtggtacttctggcagaagaagaagcagcggtccggcgtgctctgggacacccccagcccgcccgaggtcgagcgcgccgtgctggacgacggcatctaccggatcctgcagcgcgggctgctcggccggtcccaggtgggggtcggcgtgttccaggacggggtgttccacaccatgtggcacgtcacgcgcggcgccgtgctgatgtaccagggcaagcggctggagcccagctgggcctccgtgaagaaggacctcatcagctacgggggcgggtggcgcttccagggctcctggaacaccggggaggaggtccaggtgatcgccgtggagcccggcaagaacccgaagaacgtccagaccacccccggcacgttcaagacccccgagggggaggtgggcgcgatcgccctggacttcaagcccgggaccagcggctccccgatcgtgaaccgggagggcaagatcgtcgggctgtacggcaacggggtggtgaccacgagcggcacctacgtctccgccatcgcccaggccaaggcgagccaggaggggcccctccccgagatcgaggacgaggtgttcaagaagcgcaacctgaccatcatggacctgcacccgggcagcggcaagacccggcgctacctccccgccatcgtgcgggaggccatcaagcgcaagctgcgcacgctgatcctcgcccccacccgggtcgtggcgtccgagatggccgaggccctgaaggggatgcccatccgctaccagaccaccgccgtcaagagcgagcacacgggccgggagatcgtcgacctgatgtgccacgccaccttcaccatgcgcctcctgtccccggtgcgggtgcccaactacaacatgatcatcatggacgaggcgcacttcaccgaccccgccagcatcgccgcccgcgggtacatctccacgcgggtcggcatgggggaggccgcggccatcttcatgaccgccacgccgcccggcagcgtggaggccttcccccagtccaacgccgtgatccaggacgaggagcgcgacatccccgagcggagctggaactccggctacgactggatcaccgacttcagcgggaagacggtctggttcgtgccctccatcaagagcggcaacgacatcgcgaactgcctgcgcaagaacgggaagcgggtgatccagctctcccgcaagaccttcgacaccgagtaccagaagaccaagaacaacgactgggactacgtcgtgacgaccgacatcagcgagatgggcgccaacttccgggccgaccgcgtgatcgacccccggcgctgcctgaagcccgtcatcctgaaggacgggcccgagcgggtgatcctcgccggccccatgccggtcaccgtggcgtccgccgcccagcgccggggccgcatcgggcgcaaccagaacaaggagggcgaccagtacgtgtacatggggcagcccctgaacaacgacgaggaccacgcccactggaccgaggccaagatgctgctcgacaacatcaacacgcccgagggcatcatccccgcgctgttcgagccggagcgggagaagtccgccgccatcgacggggagtaccgcctgcggggcgaggcccgcaagaccttcgtcgagctcatgcggcgcggcgacctgcccgtgtggctgtcctacaaggtggccagcgaggggttccagtactccgaccggcgctggtgcttcgacggcgagcggaacaaccaggtcctcgaggagaacatggacgtggagatctggaccaaggagggggagcgcaagaagctgcggccccgctggctggacgcgcggacctacagcgaccccctcgccctgcgcgagttcaaggagttcgccgccggccggcgcagcgtgtccggcgacctgatcctcgagatcgggaagctgccgcagcacctgaccctccgggcccagaacgcgctggacaacctggtcatgctccacaacagcgagcagggcgggaaggcctaccgccacgccatggaggagctgcccgacacgatcgagaccctgatgctcctggccctgatcgcggtgctcaccggcggggtgaccctgttcttcctgtccggcaagggcctcgggaagacgagcatcggcctgctgtgcgtcaccgcctccagcgccctcctgtggatggcctccgtggagccccactggatcgccgcgagcatcatcctggagttcttcctcatggtgctgctgatccccgagccggaccggcagcgcacgccccaggacaaccagctcgcctacgtcgtgatcgggctgctgttcatgatcctcaccgtggccgccaacgagatgggcctgctggagacgaccaagaaggacctcgggatcggctacgtcgccgcggagaaccaccagcacgccaccatgctggacgtggacctgcaccccgcctccgcctggaccctctacgccgtggcgacgaccgtcatcaccccgatgatgcggcacaccatcgagaacacgaccgccaacatcagcctgaccgccatcgccaaccaggccgcgatcctgatgggcctcgacaaggggtggcccatctccaagatggacatcggcgtgcccctgctggccctcgggtgctacagccaggtgaaccccctgaccctgacggccgccgtcctcatgctggtggcgcactacgccatcatcggcccggggctgcaggccaaggccacccgcgaggcccagaagcgcaccgcggccggcatcatgaagaaccccaccgtggacggcatcgtcgccatcgacctcgaccccgtggtgtacgacgccaagttcgagaagcagctggggcagatcatgctgctcatcctgtgcacgtcccagatcctgctcatgcggaccacctgggccctgtgcgagagcatcaccctggcgacgggccccctcaccaccctgtgggaggggtccccgggcaagttctggaacaccacgatcgccgtcagcatggccaacatcttccgcggctcctacctggccggggccggcctcgcgttcagcctgatgaagtccctcgggggcgggcggcgcgggaccggcgcccagggggagaccctcggcgagaagtggaagcggcagctgaaccagctgagcaagagcgagttcaacacctacaagcgctccgggatcatggaggtggaccggagcgaggccaaggagggcctcaagcgcggggagacgaccaagcacgccgtgtcccggggcaccgcgaagctgcgctggttcgtcgagcggaacctggtgaagcccgagggcaaggtgatcgacctggggtgcggccgcgggggctggagctactactgcgccgggctcaagaaggtcaccgaggtgaagggctacaccaagggcgggcccggccacgaggagcccatcccgatggccacgtacgggtggaacctggtgaagctgcactccggcaaggacgtcttcttcatgccgcccgagaagtgcgacaccctcctgtgcgacatcggggagagctcccccaacccgaccatcgaggagggccggaccctgcgcgtgctcaagatggtggagccctggctgcggggcaaccagttctgcatcaagatcctgaacccctacatgcccagcgtcgtggagacgctcgagcagatgcagcgcaagcacgggggcatgctggtgcggaacccgctgtcccgcaacagcacccacgagatgtactgggtctcctgcgggaccggcaacatcgtgagcgccgtgaacatgacctcccggatgctcctgaaccgcttcacgatggcccaccgcaagcccacctacgagcgggacgtcgacctgggcgcggggacccgccacgtggccgtggagcccgaggtcgccaacctcgacgtgatcggccagcggatcgagaacatcaagaacgagcacaagagcacctggcactacgacgaggacaacccctacaagacgtgggcctaccacgggtcctacgaggtcaagccgagcggctccgccagctccatggtgaacggggtggtccgcctgctgaccaagccctgggacgtgatccccatggtgacccagatcgcgatgaccgacacgacccccttcggccagcagcgggtcttcaaggagaaggtggacacccgcaccccgcgggccaagcgcggcacgacccagatcatggaggtgaccgccaagtggctctgggggttcctgagccggaacaagaagccccgcatctgcacccgggaggagttcacgcgcaaggtccggagcaacgccgccatcggcgcggtgttcgtggacgagaaccagtggaactccgccaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggcgaagggcagccgcgccatctggtacatgtggctgggggcccggttcctcgagttcgaggccctgggcttcatgaacgaggaccactggttctcccgcgagaacagcctgtccggggtcgagggcgaggggctccacaagctgggctacatcctgcgggacatcagcaagatccccggcgggaacatgtacgccgacgacaccgcgggctgggacacccgcatcacggaggacgacctccagaacgaggccaagatcaccgacatcatggagccggagcacgccctgctggccacctccatcttcaagctcacctaccagaacaaggtggtgcgcgtccagcggcccgccaagaacgggacggtgatggacgtgatcagccgccgggaccagcgcggctccggccaggtcgggacctacggcctgaacaccttcaccaacatggaggtgcagctgatccggcagatggagagcgaggggatcttcctcccctccgagctggagacgcccaacctggcggagcgcgccctcgactggctggagaagcacggcgccgagcggctgaagcgcatggccatcagcggggacgactgcgtggtcaagccgatcgacgaccggttcgccaccgcgctcaccgccctgaacgacatgggcaaggtgcgcaaggacatcccccagtgggagccctccaagggctggaacgactggcagcaggtccccttctgcagccaccacttccaccagctgatcatgaaggacgggcgggagatcgtcgtgccgtgccgcaaccaggacgagctcgtgggccgggcccgcgtctcccagggggccggctggagcctgcgggagaccgcctgcctggggaagtcctacgcgcagatgtggcagctcatgtacttccaccgccgggacctgcgcctggccgccaacgccatctgcagcgcggtgcccgtggactgggtccccgccagccggaccacgtggtccatccacgcccaccaccagtggatgaccaccgaggacatgctcagcgtgtggaaccgcgtgtggatcgaggagaacccctggatggaggacaagacccacgtctccagctgggaggaggtgccgtacctgggcaagcgcgaggaccagtggtgcggctccctgatcgggctcacggcccgggccacctgggcgaccaacatccaggtggccatcaaccaggtccgccggctgatcggcaacgagaactacctggactacatgaccagcatgaagcgcttcaagaacgagtccgaccccgagggggccctctggtga

SEQ ID NO: 8862 - RNA, 9879 nt, synthetic construct
  misc_feature 1..9879: note = derived and/or modified CDS sequence (opt1) from DENV-1__KC692499__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacgcgcaccgagacctggatgagctccgagggcgcctggaagcagatccagcgggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgtcaacttcgtgtgccggcgcaccttcgtggaccggggctgggggaacggctgcgggctgttcggcaaggggagcctcctgacgtgcgccaagttcaagtgcgtcaccaagctggagggcaagatcgtgcagtacgagaacctcaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggacctccggggccagcaccagccaggagacctggaaccggcaggacctgctcgtcacgttcaagaccgcccacgccaagaagcaggaggtggtggtcctgggctcccaggagggcgcgatgcacaccgccctgaccggggccacggagatccagaccagcggcaccaccacgatcttcgccgggcacctcaagtgccgcctgaagatggacaagctgaccctcaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggccctcaagctgtcctggttcaagcgcgggagctccatcggcaagatgttcgaggcgaccgcccgcggggcgcgccgcatggccatcctgggcgacacggcctgggacttcgggagcatcggcggcgtgttcacctccgtcgggaagctcgtgcaccaggtgttcggcaccgcgtacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgccgcgatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcccaggggaagaagatgatccgcccccagcccatggagtacaagtactcctggaagtcctggggcaaggcgaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgccgcgatcaaggactccaaggccgtccacgccgacatgggctactggatcgagagcgagaagaacgagacctggaagctggcccgcgcctccttcatcgaggtgaagacctgcacgtggcccaagagccacaccctgtggtccaacggggtgctcgagagcgagatgatcatccccaagatcttcggcgggccgatctcccagcacaactaccggcccggctacttcacccagaccgcggggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcctccgaccgcatgggcatgggcaccacctacctggcgctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggccatgggcatcatgatgctcaagctgctgaccgagttccagccccaccagctctggacgaccctgctgagcctcaccttcgtgaagaccacgctgtccctggactacgcgtggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtcagcatcctgctgtccagcctcctgaagaacgacgtgcccctggccggcccgctcatcgcgggcgggatgctgatcgcctgctacgtgatcagcggctccagcgccgacctgtccctcgagaaggccgccgaggtcagctgggagcaggaggcggagcactccggggccagccacaacatcctggtggaggtgcaggacgacggcacgatgaagatcaaggacgaggagcgcgacgacaccctgaccatcctcctgaaggccaccctgctcgccgtctccggggtgtaccccatgagcatccccgccacgctgttcgtgtggtacttctggcagaagaagaagcagcggtccggcgtcctgtgggacacccccagcccgcccgaggtggagcgcgcggtgctcgacgacggcatctaccggatcctgcagcgcgggctgctgggccggtcccaggtcggggtgggcgtgttccaggacggggtcttccacaccatgtggcacgtgacccgcggcgccgtgctcatgtaccagggcaagcggctggagcccagctgggcctccgtcaagaaggacctgatcagctacgggggcgggtggcgcttccagggctcctggaacacgggggaggaggtccaggtgatcgccgtcgagcccggcaagaacccgaagaacgtgcagaccacccccggcaccttcaagacgcccgagggggaggtgggcgccatcgcgctcgacttcaagcccgggaccagcggctccccgatcgtcaaccgggagggcaagatcgtggggctgtacggcaacggggtggtcaccaccagcggcacgtacgtgtccgccatcgcccaggccaaggccagccaggaggggcccctgcccgagatcgaggacgaggtgttcaagaagcgcaacctcaccatcatggacctgcacccgggcagcggcaagacccggcgctacctgcccgcgatcgtccgggaggccatcaagcgcaagctccgcaccctgatcctggcccccacgcgggtggtggcctccgagatggcggaggccctcaaggggatgcccatccgctaccagaccaccgccgtcaagagcgagcacaccggccgggagatcgtggacctgatgtgccacgccacgttcaccatgcgcctgctctccccggtgcgggtccccaactacaacatgatcatcatggacgaggcccacttcaccgaccccgcgagcatcgccgcccgcgggtacatctccacccgggtgggcatgggggaggccgccgcgatcttcatgacggccacgccgcccggcagcgtggaggccttcccccagtccaacgccgtcatccaggacgaggagcgcgacatccccgagcggagctggaactccggctacgactggatcgccgacttccccgggaagaccgtgtggttcgtgcccagcatcaagtccggcaacgacatcgcgaactgcctgcgcaagaacgggaagcgggtcatccagctgagccgcaagaccttcgacacggagtaccagaagaccaagaacaacgactgggactacgtggtgaccaccgacatctccgagatgggcgccaacttccgggccgaccgcgtcatcgacccccggcgctgcctcaagcccgtgatcctgaaggacgggcccgagcgggtcatcctggccggcccgatgcccgtgacggtggcgagcgccgcccagcgccggggccgcatcgggcgcaaccagaacaaggagggcgaccagtacgtctacatggggcagcccctcaacaacgacgaggaccacgcccactggaccgaggccaagatgctgctggacaacatcaacacccccgagggcatcatcccggccctcttcgagcccgagcgggagaagtccgccgccatcgacggggagtaccgcctgcggggcgaggcccgcaagaccttcgtggagctgatgcggcgcggcgacctccccgtgtggctgagctacaaggtcgcctccgaggggttccagtacagcgaccggcgctggtgcttcgacggcgagcggaacaaccaggtgctggaggagaacatggacgtggagatctggacgaaggagggggagcgcaagaagctccggccccgctggctggacgcgcggacctactccgacccgctggccctccgcgagttcaaggagttcgccgccggccggcgcagcgtcagcggcgacctgatcctggagatcgggaagctcccccagcacctgaccctgcgggcccagaacgcgctcgacaacctggtgatgctgcacaactccgagcagggcgggaaggcctaccgccacgccatggaggagctccccgacaccatcgagaccctgatgctgctcgccctgatcgcggtgctgacgggcggggtcaccctcttcttcctgagcggcaagggcctggggaagacctccatcggcctcctgtgcgtgaccgccagctccgccctgctctggatggccagcgtggagccccactggatcgccgcgtccatcatcctggagttcttcctgatggtcctcctgatcccggagcccgaccggcagcgcacgccccaggacaaccagctggcctacgtggtgatcgggctcctgttcatgatcctgaccgtcgccgccaacgagatgggcctcctggagaccaccaagaaggacctggggatcggctacgtggccgcggagaaccaccagcacgccacgatgctcgacgtggacctgcacccggccagcgcctggaccctgtacgccgtcgcgaccaccgtgatcacgcccatgatgcggcacaccatcgagaacaccaccgccaacatctccctcacggccatcgccaaccaggccgcgatcctgatgggcctggacaaggggtggcccatcagcaagatggacatcggcgtgcccctcctggccctggggtgctactcccaggtcaacccgctcaccctgaccgccgccgtgctgatgctcgtggcgcactacgccatcatcggccccgggctgcaggccaaggccacccgcgaggcccagaagcgcacggcggccggcatcatgaagaaccccaccgtcgacggcatcgtggccatcgacctggaccccgtggtctacgacgccaagttcgagaagcagctcgggcagatcatgctgctgatcctctgcaccagccagatcctgctgatgcggaccacgtgggccctctgcgagtccatcaccctggcgaccggcccgctgaccacgctctgggaggggagccccggcaagttctggaacaccaccatcgccgtgtccatggccaacatcttccgcggcagctacctggccggggccggcctggcgttctccctcatgaagtccctcgggggcgggcggcgcgggaccggcgcccagggggagacgctgggcgagaagtggaagcggcagctcaaccagctgtccaagagcgagttcaacacctacaagcgcagcgggatcatggaggtggaccggtccgaggccaaggagggcctgaagcgcggggagaccaccaagcacgccgtcagccggggcacggcgaagctccgctggttcgtggagcggaacctggtgaagcccgagggcaaggtcatcgacctggggtgcggccgcgggggctggtcctactactgcgccgggctgaagaaggtgaccgaggtgaagggctacaccaagggcgggcccggccacgaggagccgatccccatggccacctacgggtggaacctcgtcaagctgcacagcggcaaggacgtgttcttcatgccgcccgagaagtgcgacaccctgctctgcgacatcggggagtccagcccgaaccccacgatcgaggagggccggaccctgcgcgtgctgaagatggtcgagccctggctccggggcaaccagttctgcatcaagatcctgaacccctacatgccgtccgtggtggagaccctggagcagatgcagcgcaagcacgggggcatgctcgtccggaaccccctgagccgcaactccacccacgagatgtactgggtgagctgcgggacgggcaacatcgtgtccgccgtcaacatgaccagccggatgctgctcaaccgcttcaccatggcccaccgcaagcccacctacgagcgggacgtggacctgggcgcggggacgcgccacgtggccgtcgagcccgaggtggccaacctggacatcatcggccagcggatcgagaacatcaagaacgagcacaagtccacctggcactacgacgaggacaacccgtacaagacctgggcctaccacgggagctacgaggtcaagccctccggcagcgcctccagcatggtgaacggggtggtccgcctcctgaccaagccctgggacgtgatccccatggtgacgcagatcgcgatgaccgacaccaccccgttcggccagcagcgggtcttcaaggagaaggtggacacgcgcacgccccgggccaagcgcggcaccacccagatcatggaggtgacggccaagtggctgtgggggttcctctcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctggtgcaccgggagcgcgagctgcacaagcaggggaagtgcgcgacctgcgtgtacaacatgatgggcaagcgggagaagaagctcggggagttcggcaaggcgaagggctcccgcgccatctggtacatgtggctgggggcccggttcctggagttcgaggccctcggcttcatgaacgaggaccactggttcagccgcgagaactccctgagcggggtcgagggcgaggggctgcacaagctcggctacatcctgcgggacatctccaagatcccgggcgggaacatgtacgccgacgacacggcgggctgggacacccgcatcaccgaggacgacctgcagaacgaggccaagatcaccgacatcatggagcccgagcacgccctcctggccacgagcatcttcaagctgacctaccagaacaaggtggtgcgcgtccagcggcccgccaagaacgggaccgtgatggacgtgatctcccgccgggaccagcgcggcagcggccaggtcgggacctacggcctcaacacgttcaccaacatggaggtgcagctgatccggcagatggagtccgaggggatcttcctgcccagcgagctcgagaccccgaacctggcggagcgcgccctggactggctcgagaagcacggcgccgagcggctgaagcgcatggccatctccggggacgactgcgtggtcaagcccatcgacgaccggttcgccaccgcgctgacggccctcaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctggtgggccgggcccgcgtcagccagggggccggctggtccctccgggagaccgcctgcctgggcaagagctacgcgcagatgtggcagctgatgtacttccaccgccgggacctccgcctggccgccaacgccatctgctccgcggtgcccgtggactgggtccccgccagccggaccacctggagcatccacgcccaccaccagtggatgaccacggaggacatgctgtccgtgtggaaccgcgtgtggatcgaggagaacccgtggatggaggacaagacccacgtcagctcctgggaggaggtgccctacctcggcaagcgcgaggaccagtggtgcggcagcctgatcgggctgaccgcccgggccacctgggcgacgaacatccaggtggccatcaaccaggtccgccggctcatcggcaacgagaactacctggactacatgacctccatgaagcgcttcaagaacgagagcgaccccgagggggccctgtggtga

SEQ ID NO: 8863 - RNA, 9879 nt, synthetic construct
  misc_feature 1..9879: note = derived and/or modified CDS sequence (opt1) from DENV-1__KC692500__SS-prME
  source 1..9879: mol_type = other RNA
agcgtgaccatgctgctcatgctgctgcccaccgcgctcgccttccacctgaccacccgcggcggggagccccacatgatcgtgagcaagcaggagcggggcaagagcctcctcttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccacccggggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccgcaccggcctggacttcaacgagatggtcctgctcacgatgaaggggaagtcctggctggtgcacaagcagtggttcctggacctcccgctgccctggacctccggcgccagcaccagccaggagacctggaaccggcaggacctgctcgtgacgttcaagaccgcccacgcgaagaagcaggaggtcgtggtgctgggctcccaggagggggccatgcacaccgccctgaccggcgccacggagatccagaccagcgggaccaccacgatcttcgccggccacctcaagtgccgcctgaagatggacaagctgaccctcaaggggatgtcctacgtcatgtgcaccggcagcttcaagctggagaaggaggtggcggagacccagcacggcacggtgctggtccaggtgaagtacgaggggaccgacgccccctgcaagatccccttctccacccaggacgagaagggcgtgacccagaacgggcggctgatcacggccaacccgatcgtcaccgacaaggagaagcccgtgaacatcgagaccgagccgcccttcggcgagagctacatcgtggtcggcgccggggagaaggcgctcaagctgtcctggttcaagcgcggcagctccatcgggaagatgttcgaggccaccgcccggggcgcccgccgcatggccatcctgggggacacggcgtgggacttcggcagcatcggcggggtgttcacctccgtgggcaagctcgtccaccaggtgttcgggaccgcctacggcgtgctgttcagcggggtctcctggaccatgaagatcggcatcggcatcctgctcacgtggctggggctgaacagccggtccaccagcctctccatgacctgcatcgccgtgggcatggtgaccctgtacctgggggtcatggtgcaggccgacagcggctgcgtgatcaactggaaggggcgcgagctcaagtgcggctccggcatcttcgtcacgaacgaggtgcacacctggaccgagcagtacaagttccaggccgacagcccgaagcggctgagcgcggccatcgggaaggcctgggaggagggcgtgtgcgggatccgctccgccacccggctggagaacatcatgtggaagcagatcagcaacgagctcaaccacatcctgctggagaacgacatgaagttcaccgtcgtggtgggcgacgccaacgggatcctcgcgcagggcaagaagatgatccgcccccagcccatggagcacaagtactcctggaagtcctggggcaaggccaagatcatcggggccgacatccagaacacgaccttcatcatcgacggccccgacaccccggagtgccccgacgggcagcgggcctggaacatctgggaggtcgaggactacggcttcggcgtgttcaccacgaacatctggctgaagctgcgcgactcctacacccagatgtgcgaccaccggctcatgagcgcggccatcaaggactccaaggccgtgcacgccgacatggggtactggatcgagagcgagaagaacgagacctggaagctggcccgcgcgtccttcatcgaggtcaagacctgcacgtggcccaagagccacaccctgtggtccaacggcgtgctcgagagcgagatgatcatccccaagatcttcgggggcccgatctcccagcacaactaccggcccgggtacttcacccagaccgccggcccctggcacctgggcaagctggagctcgacttcgacctgtgcgaggggacgaccgtggtcgtggacgagcactgcggcaaccgcgggccgagcctgcggaccaccacggtgaccggcaagatcatccacgagtggtgctgccgctcctgcaccctgccgcccctgcggttccgcggggaggacggctgctggtacggcatggagatccggcccgtcaaggagaaggaggagaacctggtgcgcagcatggtgtccgccgggagcggcgaggtcgacagcttctccctcgggatcctgtgcgtgagcatcatgatcgaggaggtgatgcggtcccgctggagccgcaagatgctgatgaccggcacgctcgccgtcttcctgctgctcatcatggggcagctgacctggaacgacctgatccggctctgcatcatggtgggcgccaacgcgtccgaccgcatgggcatggggaccacctacctggccctgatggccacgttcaagatgcggccgatgttcgccgtgggcctcctgttccgccggctgaccagccgcgaggtcctcctgctgaccatcgggctctccctggtggccagcgtcgagctgcccaactccctcgaggagctgggcgacggcctggcgatggggatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcggcagcttcgggtgcaagcccctgaccatgttcctgatcaccgagaacaagatctggggccggaagtcctggcccctcaacgaggggatcatggccatcggcatcgtgagcatcctgctgtccagcctcctgaagaacgacgtccccctggcgggcccgctcatcgccgggggcatgctgatcgcctgctacgtgatcagcgggtccagcgccgacctgtccctcgagaaggccgcggaggtgagctgggagcaggaggccgagcactccggcgccagccacaacatcctggtcgaggtgcaggacgacgggacgatgaagatcaaggacgaggagcgcgacgacaccctgaccatcctcctgaaggccaccctgctcgccgtgtccggcgtctaccccatgagcatccccgcgacgctgttcgtgtggtacttctggcagaagaagaagcagcggtccggcgtgctgtgggacacccccagcccgcccgaggtcgagcgcgccgtgctcgacgacgggatctaccggatcctgcagcgcggcctgctggggcggtcccaggtgggcgtcggggtgttccaggacggcgtgttccacaccatgtggcacgtcacccgcggcgccgtgctcatgtaccaggggaagcggctggagcccagctgggcctccgtgaagaaggacctgatcagctacggcgggggctggcgcttcaaggggtcctggaacacgggcgaggaggtccaggtgatcgccgtggagcccggcaagaacccgaagaacgtccagaccacccccgggaccttcaagacgcccgagggcgaggtgggggcgatcgccctcgacttcaagcccggcaccagcggctccccgatcgtgaaccgggaggggaagatcgtcggcctgtacgggaacggcgtggtgaccaccagcgggacgtacgtctccgccatcgcccaggccaaggcgagccaggagggccccctgcccgagatcgaggacgaggtgttcaagaagcgcaacctcaccatcatggacctgcacccgggcagcgggaagacccggcgctacctgcccgccatcgtgcgggaggccatcaagcgcaagctccgcaccctgatcctggcccccacgcgggtcgtggcgtccgagatggccgaggccctcaagggcatgcccatccgctaccagaccaccgccgtcaagagcgagcacaccgggcgggagatcgtcgacctgatgtgccacgccacgttcaccatgcgcctgctctccccggtgcgggtgcccaactacaacatgatcatcatggacgaggcgcacttcaccgaccccgccagcatcgccgcccgcggctacatctccacccgggtcgggatgggcgaggccgcggccatcttcatgacggccacgccgcccggcagcgtggaggccttcccccagtccaacgccgtgatccaggacgaggagcgcgacatccccgagcggagctggaactccgggtacgactggatcaccgacttccccggcaagaccgtctggttcgtgcccagcatcaagtccgggaacgacatcgcgaactgcctgcgcaagaacggcaagcgggtgatccagctgagccgcaagacgttcgacaccgagtaccagaagaccaagaacaacgactgggactacgtcgtgaccacggacatctccgagatgggggccaacttccgggccgaccgcgtgatcgacccccggcgctgcctcaagcccgtcatcctgaaggacggccccgagcgggtgatcctggccggcccgatgcccgtcaccgtggcgagcgccgcccagcgccgggggcgcatcggccgcaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgcggggcgaggcccgcaagacgttcgtcgagctgatgcggcgcggggacctccccgtgtggctgagctacaaggtggcctccgagggcttccagtacagcgaccggcgctggtgcttcgacggggagcggaacaaccaggtcctggaggagaacatggacgtggagatctggaccaaggagggcgagcgcaagaagctccggccccgctggctggacgcgcggacctactccgacccgctggccctccgcgagttcaaggagttcgccgccggccggcgcagcgtgagcggggacctgatcctggagatcggcaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccgggggcgtgaccctcttcttcctgagcggcaaggggctgggcaagacctccatcgggctcctgtgcgtcacggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcggcctcctgttcatgatcctgaccgtggccgccaacgagatggggctcctggagaccacgaagaaggacctgggcatcggctacgtcgccgcggagaaccaccagcacgccaccatgctcgacgtggacctgcacccggccagcgcctggaccctgtacgccgtggcgaccacggtcatcacccccatgatgcggcacaccatcgagaacaccacggccaacatctccctcaccgccatcgccaaccaggccgcgatcctgatggggctggacaagggctggcccatcagcaagatggacatcggggtgcccctcctggccctgggctgctactcccaggtgaacccgctcaccctgaccgccgccgtcctgatgctcgtggcgcactacgccatcatcgggcccggcctgcaggccaaggccacgcgcgaggcccagaagcgcaccgcggccggcatcatgaagaaccccaccgtggacgggatcgtcgccatcgacctggaccccgtggtgtacgacgccaagttcgagaagcagctcggccagatcatgctgctgatcctctgcaccagccagatcctgctgatgcggacgacctgggccctctgcgagtccatcaccctggcgaccgggccgctgacgaccctctgggagggcagccccggcaagttctggaacaccaccatcgccgtctccatggccaacatcttccgcgggagctacctggccggcgccgggctggcgttctccctcatgaagtccctgggcgggggccggcgcggcacgggggcccagggcgagaccctgggggagaagtggaagcggcagctcaaccagctgtccaagagcgagttcaacacctacaagcgcagcggcatcatggaggtggaccggtccgaggccaaggaggggctgaagcgcggcgagaccacgaagcacgccgtgagccggggcaccgcgaagctccgctggttcgtcgagcggaacctggtgaagcccgaggggaaggtgatcgacctgggctgcgggcgcggcgggtggtcctactactgcgccggcctgaagaaggtcaccgaggtgaagggctacaccaagggcgggcccgggcacgaggagccgatccccatggccacctacggctggaacctcgtgaagctgcacagcgggaaggacgtcttcttcatgccgcccgagaagtgcgacacgctgctctgcgacatcggcgagtccagcccgaaccccaccatcgaggagggccggaccctgcgcgtgctgaagatggtggagccctggctccgggggaaccagttctgcatcaagatcctgaacccctacatgccgtccgtcgtggagaccctggagcagatgcagcgcaagcacggcgggatgctcgtgcggaaccccctgagccgcaactccacgcacgagatgtactgggtcagctgcggcaccggcaacatcgtgtccgccgtgaacatgaccagccggatgctgctcaaccgcttcaccatggcccaccgcaagcccacgtacgagcgggacgtcgacctgggggcgggcacccgccacgtggccgtggagcccgaggtcgccaacctggacatcatcgggcagcggatcgagaacatcaagaacgagcacaagtccacctggcactacgacgaggacaacccgtacaagacctgggcctaccacggcagctacgaggtgaagccctccgggagcgcctccagcatggtcaacggcgtggtgcgcctcctgacgaagccctgggacgtcatccccatggtgacccagatcgcgatgaccgacaccacgccgttcggccagcagcgggtgttcaaggagaaggtcgacacccgcacgccccgggccaagcgcgggaccacgcagatcatggaggtgaccgccaagtggctgtggggcttcctctcccggaacaagaagccccgcatctgcacccgggaggagttcacccgcaaggtgcggagcaacgccgccatcggggcggtcttcgtggacgagaaccagtggaacagcgccaaggaggccgtggaggacgagcgcttctgggacctggtccaccgggagcgcgagctgcacaagcagggcaagtgcgccacgtgcgtgtacaacatgatggggaagcgggagaagaagctcggcgagttcggcaaggcgaaggggtcccgcgccatctggtacatgtggctgggcgcccggttcctggagttcgaggccctcgggttcatgaacgaggaccactggttcagccgcgagaactccctgagcggcgtggagggggagggcctgcacaagctcggctacatcctgcgggacatctccaagatccccggcgggaacatgtacgccgacgacaccgcggggtgggacacccgcatcaccgaggacgacctgcagaacgaggccaagatcacggacatcatggagcccgagcacgccctcctggccaccagcatcttcaagctgacctaccagaacaaggtcgtgcgcgtgcagcggcccgccaagaacgggaccgtcatggacgtgatctcccgccgggaccagcgcggcagcggccaggtgggcacgtacgggctcaacaccttcaccaacatggaggtccagctgatccggcagatggagtccgagggcatcttcctgcccagcgagctcgagaccccgaacctggcggagcgcgccctggactggctcgagaagcacggggccgagcggctgaagcgcatggccatctccggcgacgactgcgtggtgaagcccatcgacgaccggttcgccacggcgctgaccgccctcaacgacatgggcaaggtccgcaaggacatcccccagtgggagcccagcaaggggtggaacgactggcagcaggtcccgttctgctcccaccacttccaccagctgatcatgaaggacggccgggagatcgtggtcccctgccgcaaccaggacgagctggtggggcgggcccgcgtgagccagggcgccgggtggtccctccgggagaccgcctgcctgggcaagagctacgcgcagatgtggcagctgatgtacttccaccgccgggacctccgcctggccgccaacgccatctgctccgcggtccccgtggactgggtgcccgccagccggaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcggcaagcgcgaggaccagtggtgcgggagcctgatcggcctgaccgcccgggccacgtgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8864 - RNA, 9879 nt, synthetic construct
  misc_feature 1..9879: note = derived and/or modified CDS sequence (opt1) from DENV-1__KC692501__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccggtccaccagcctctccatgacctgcatcgccgtggggatggtgaccctgtacctgggcgtcatggtgcaggccgacagcgggtgcgtgatcaactggaagggccgcgagctcaagtgcgggtccggcatcttcgtcacgaacgaggtgcacacctggaccgagcagtacaagttccaggccgacagcccgaagcggctgagcgcggccatcggcaaggcctgggaggagggggtgtgcggcatccgctccgccacccggctggagaacatcatgtggaagcagatcagcaacgagctcaaccacatcctgctggagaacgacatgaagttcaccgtcgtggtgggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtcgaggactacgggttcggcgtgttcaccacgaacatctggctgaagctgcgcgactcctacacccagatgtgcgaccaccggctcatgagcgcggccatcaaggactccaaggccgtgcacgccgacatgggctactggatcgagagcgagaagaacgagacctggaagctggcccgcgcgtccttcatcgaggtcaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtggtcgtggacgagcactgcgggaaccgcggcccgagcctgcggaccaccacggtgaccgggaagatcatccacgagtggtgctgccgctcctgcaccctgccgcccctgcggttccgcggcgaggacgggtgctggtacggcatggagatccggcccgtcaaggagaaggaggagaacctggtgcgcagcatggtgtccgccggcagcggggaggtcgacagcttctccctcggcatcctgtgcgtgagcatcatgatcgaggaggtgatgcggtcccgctggagccgcaagatgctgatgaccgggacgctcgccgtcttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtggggctcctgttccgccggctgaccagccgcgaggtcctcctgctgaccatcggcctctccctggtggccagcgtcgagctgcccaactccctcgaggagctgggggacggcctggcgatgggcatcatgatgctcaagctgctgaccgagttccagccccaccagctctggacgaccctgctgagcctcaccttcgtgaagaccacgctgtccctggactacgcctggaagaccaccgccatggtgctcagcatcgtctccctgttccccctgtgcctcagcaccacgtcccagaagaccacctggctgccggtgctgctcgggagcttcggctgcaagcccctgaccatgttcctgatcaccgagaacaagatctgggggcggaagtcctggcccctcaacgagggcatcatggccatcgggatcgtgagcatcctgctgtccagcctcctgaagaacgacgtccccctggcgggcccgctcatcgccggcgggatgctgatcgcctgctacgtgatcagcggctccagcgccgacctgtccctcgagaaggccgcggaggtgagctgggagcaggaggccgagcactccggggccagccacaacatcctggtcgaggtgcaggacgacggcacgatgaagatcaaggacgaggagcgcgacgacaccctgaccatcctcctgaaggccaccctgctcgccgtgtccggggtctaccccatgagcatccccgcgacgctgttcgtgtggtacttctggcagaagaagaagcagcggtccggcgtgctgtgggacacccccagcccgcccgaggtcgagcgcgccgtgctcgacgacggcatctaccggatcctgcagcgcgggctgctgggccggtcccaggtgggggtcggcgtgttccaggacggggtgttccacaccatgtggcacgtcacccgcggcgccgtgctcatgtaccagggcaagcggctggagcccagctgggcctccgtgaagaaggacctgatcagctacgggggcgggtggcgcttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgggaggagaagatcgtcggcctgtacgggaacggcgtggtgaccaccagcgggacgtacgtctccgccatcgcccaggccaaggcgagccaggagggccccctgcccgagatcgaggacgaggtgttcaagaagcgcaacctcaccatcatggacctgcacccggggagcggcaagacccggcgctacctgcccgccatcgtgcgggaggccatcaagcgcaagctccgcaccctgatcctggcccccacgcgggtcgtggcgtccgagatggccgaggccctcaagggcatgcccatccgctaccagaccaccgccgtcaagagcgagcacaccgggcgggagatcgtcgacctgatgtgccacgccacgttcaccatgcgcctgctctccccggtgcgggtgcccaactacaacatgatcatcatggacgaggcgcacttcaccgaccccgccagcatcgccgcccgcggctacatctccacccgggtcgggatgggcgaggccgcggccatcttcatgacggccacgccgcccgggagcgtggaggccttcccccagtccaacgccgtgatccaggacgaggagcgcgacatccccgagcggagctggaactccggctacgactggatcaccgacttccccggcaagaccgtctggttcgtgcccagcatcaagtccgggaacgacatcgcgaactgcctgcgcaagaacggcaagcgggtgatccagctgagccgcaagacgttcgacaccgagtaccagaagaccaagaacaacgactgggactacgtcgtgaccacggacatctccgagatgggggccaacttccgggccgaccgcgtgatcgacccccggcgctgcctcaagcccgtcatcctgaaggacggccccgagcgggtgatcctggccgggccgatgcccgtcaccgtggcgagcgccgcccagcgccggggccgcatcggccgcaaccagaacaaggagggggaccagtacgtgtacatgggccagcccctcaacaacgacgaggaccacgcccactggaccgaggccaagatgctgctggacaacatcaacacccccgaggggatcatcccggccctcttcgagcccgagcgggagaagtccgccgccatcgacggcgagtaccgcctgcgcggggaggcccgcaagacgttcgtcgagctgatgcggcgcggcgacctccccgtgtggctgagctacaaggtggcctccgagggcttccagtacagcgaccggcgctggtgcttcgacggggagcggaacaaccaggtcctggaggagaacatggacgtggagatctggaccaaggagggcgagcgcaagaagctccggccccgctggctggacgcgcggacctactccgacccgctggccctccgcgagttcaaggagttcgccgccgggcggcgcagcgtgagcggcgacctgatcctggagatcggcaagctcccccagcacctgaccctgcgggcccagaacgcgctcgacaacctggtcatgctgcacaactccgagcagggcgggaaggcctaccgccacgccatggaggagctccccgacaccatcgagacgctgatgctgctcgccctgatcgcggtgctgaccgggggcgtgaccctcttcttcctgagcgggaagggcctgggcaagacctccatcgggctcctgtgcgtcacggccagctccgccctgctctggatggccagcgtggagccccactggatcgccgcgtccatcatcctggagttcttcctgatggtgctcctgatcccggagcccgaccggcagcgcacgccccaggacaaccagctggcctacgtcgtgatcggcctcctgttcatgatcctgaccgtggccgccaacgagatggggctcctggagaccacgaagaaggacctgggcatcgggtacgtcgccgcggagaaccaccagcacgccaccatgctcgacgtggacctgcacccggccagcgcctggaccctgtacgccgtggcgaccacggtcatcacccccatgatgcggcacaccatcgagaacaccacggccaacatctccctcaccgccatcgccaaccaggccgcgatcctgatgggcctggacaagggctggcccatcagcaagatggacatcggggtgcccctcctggccctgggctgctactcccaggtgaacccgctcaccctgaccgccgccgtcctgatgctcgtggcgcactacgccatcatcgggcccggcctgcaggccaaggccacgcgcgaggcccagaagcgcaccgcggccgggatcatgaagaaccccaccgtggacggcatcgtcgccatcgacctggaccccgtggtgtacgacgccaagttcgagaagcagctcggccagatcatgctgctgatcctctgcaccagccagatcctgctgatgcggacgacctgggccctctgcgagtccatcaccctggcgaccgggccgctgacgaccctctgggagggcagccccgggaagttctggaacaccaccatcgccgtctccatggccaacatcttccgcggcagctacctggccggcgccgggctggcgttctccctcatgaagtccctgggcgggggccggcgcgggacgggcgcccagggcgagaccctgggggagaagtggaagcggcagctcaaccagctgtccaagagcgagttcaacacctacaagcgcagcggcatcatggaggtggaccggtccgaggccaaggaggggctgaagcgcggcgagaccacgaagcacgccgtgagccgggggaccgcgaagctccgctggttcgtcgagcggaacctggtgaagcccgagggcaaggtgatcgacctgggctgcgggcgcggcgggtggtcctactactgcgccggcctgaagaaggtcaccgaggtgaaggggtacaccaagggcggccccgggcacgaggagccgatccccatggccacctacggctggaacctcgtgaagctgcacagcgggaaggacgtcttcttcatgccgcccgagaagtgcgacacgctgctctgcgacatcggcgagtccagcccgaaccccaccatcgaggaggggcggaccctgcgcgtgctgaagatggtggagccctggctccggggcaaccagttctgcatcaagatcctgaacccctacatgccgtccgtcgtggagaccctggagcagatgcagcgcaagcacggcgggatgctcgtgcggaaccccctgagccgcaactccacgcacgagatgtactgggtcagctgcggcaccgggaacatcgtgtccgccgtgaacatgaccagccggatgctgctcaaccgcttcaccatggcccaccgcaagcccacgtacgagcgggacgtcgacctgggcgcgggcacccgccacgtggccgtggagcccgaggtcgccaacctggacatcatcgggcagcggatcgagaacatcaagaacgagcacaagtccacctggcactacgacgaggacaacccgtacaagacctgggcctaccacggcagctacgaggtgaagccctccgggagcgcctccagcatggtcaacggcgtggtgcgcctcctgacgaagccctgggacgtcatccccatggtgacccagatcgcgatgaccgacaccacgccgttcgggcagcagcgggtgttcaaggagaaggtcgacacccgcacgccccgggccaagcgcggcaccacgcagatcatggaggtgaccgccaagtggctgtggggcttcctctcccggaacaagaagccccgcatctgcacccgggaggagttcacccgcaaggtgcggagcaacgccgccatcggggcggtcttcgtggacgagaaccagtggaacagcgccaaggaggccgtggaggacgagcgcttctgggacctggtccaccgggagcgcgagctgcacaagcagggcaagtgcgccacgtgcgtgtacaacatgatggggaagcgggagaagaagctcggcgagttcgggaaggcgaagggctcccgcgccatctggtacatgtggctgggcgcccggttcctggagttcgaggccctcgggttcatgaacgaggaccactggttcagccgcgagaactccctgagcggcgtggagggggagggcctgcacaagctcgggtacatcctgcgggacatctccaagatcccgggcggcaacatgtacgccgacgacaccgcggggtgggacacccgcatcaccgaggacgacctgcagaacgaggccaagatcacggacatcatggagcccgagcacgccctcctggccaccagcatcttcaagctgacctaccagaacaaggtcgtgcgcgtgcagcggcccgccaagaacggcaccgtcatggacgtgatctcccgccgggaccagcgcgggagcggccaggtgggcacgtacgggctcaacaccttcaccaacatggaggtccagctgatccggcagatggagtccgagggcatcttcctgcccagcgagctcgagaccccgaacctggcggagcgcgccctggactggctcgagaagcacggggccgagcggctgaagcgcatggccatctccggcgacgactgcgtggtgaagcccatcgacgaccggttcgccacggcgctgaccgccctcaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctggtggggcgggcccgcgtgagccagggcgccgggtggtccctccgggagaccgcctgcctgggcaagagctacgcgcagatgtggcagctgatgtacttccaccgccgggacctccgcctggccgccaacgccatctgctccgcggtccccgtggactgggtgcccgccagccggaccacctggagcatccacgcccaccaccagtggatgacgaccgaggacatgctgtccgtctggaaccgcgtgtggatcgaggagaacccgtggatggaggacaagacccacgtgagctcctgggaggaggtcccctacctcgggaagcgcgaggaccagtggtgcggcagcctgatcggcctgaccgcccgggccacgtgggcgaccaacatccaggtggccatcaaccaggtgcgccggctcatcgggaacgagaactacctggactacatgacctccatgaagcgcttcaagaacgagagcgaccccgagggcgccctgtggtga

SEQ ID NO: 8865 - RNA, 9879 nt, synthetic construct
  misc_feature 1..9879: note = derived and/or modified CDS sequence (opt1) from DENV-1__KC692502__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggaagcagatccagcgggtggagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcgtctcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccggctgatcacggccaacccgatcgtgaccgacaaggagaagcccgtgaacatcgagaccgagccgcccttcggggagagctacatcgtcgtgggcgccggcgagaaggcgctcaagctgtcctggttcaagcgcgggagctccatcggcaagatgttcgaggccaccgcccgcggggcgcgccgcatggccatcctgggcgacacggcgtgggacttcgggagcatcggcggcgtgttcacctccgtcgggaagctcgtgcaccaggtgttcggcaccgcctacggggtcctgttcagcggcgtgtcctggaccatgaagatcgggatcggcatcctgctcacgtggctgggcctgaacagccggtccaccagcctctccatgacctgcatcgccgtggggatggtcaccctgtacctgggcgtgatggtgcaggccgacagcgggtgcgtcatcaactggaagggccgcgagctcaagtgcgggtccggcatcttcgtgacgaacgaggtgcacacctggaccgagcagtacaagttccaggccgacagcccgaagcggctgagcgcggccatcggcaaggcctgggaggagggggtctgcggcatccgctccgccacccggctggagaacatcatgtggaagcagatcagcaacgagctcaaccacatcctgctggagaacgacatgaagttcaccgtggtggtcggggacgccaacggcatcctcgcgcaggggaagaagatgatccgcccccagcccatggagcacaagtactcctggaagtcctggggcaaggccaagatcatcggcgccgacatccagaacacgaccttcatcatcgacgggcccgacaccccggagtgccccgacggccagcgggcctggaacatctgggaggtggaggactacgggttcggcgtgttcaccacgaacatctggctgaagctgcgcgactcctacacccagatgtgcgaccaccggctcatgagcgcggccatcaaggactccaaggccgtccacgccgacatgggctactggatcgagagcgagaagaacgagacctggaagctggcccgcgcgtccttcatcgaggtgaagacctgcacgtggcccaagagccacaccctgtggtccaacggggtgctcgagagcgagatgatcatccccaagatcttcggcgggccgatctcccagcacaactaccggcccggctacttcacccagaccgccgggccctggcacctgggcaagctggagctcgacttcgacctgtgcgagggcacgaccgtcgtggtggacgagcactgcgggaaccgcggcccgagcctgcggaccaccacggtcaccgggaagatcatccacgagtggtgctgccgctcctgcaccctgccgcccctgcggttccgcggcgaggacgggtgctggtacggcatggagatccggcccgtgaaggagaaggaggagaacctggtgcgcagcatggtctccgccggcagcggggaggtggacagcttctccctcggcatcctgtgcgtgagcatcatgatcgaggaggtcatgcggtcccgctggagccgcaagatgctgatgaccgggacgctcgccgtgttcctgctgctcatcatgggccagctgacctggaacgacctgatccggctctgcatcatggtgggggccaacgcgtccgaccgcatgggcatgggcaccacctacctggccctgatggccacgttcaagatgcggccgatgttcgccgtcgggctcctgttccgccggctgaccagccgcgaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtgcggaccacgctgtccctggactacgcctggaagaccaccgccatggtcctcagcatcgtgtccctgttccccctgtgcctcagcaccacgtcccagaagaccacctggctgccggtgctgctcgggagcttcggctgcaagcccctgaccatgttcctgatcaccgagaacaagatctgggggcgcaagtcctggcccctcaacgagggcatcatggccatcgggatcgtcagcatcctgctgtccagcctcctgaagaacgacgtgcccctggcgggcccgctcatcgccggcgggatgctgatcgcctgctacgtgatcagcggctccagcgccgacctgtccctcgagaaggccgcggaggtcagctgggagcaggaggccgagcactccggggccagccacaacatcctggtggaggtgcaggacgacggcacgatgaagatcaaggacgaggagcgggacgacaccctgaccatcctcctgaaggccaccctgctcgccgtctccggggtgtaccccatgagcatccccgcgacgctgttcgtgtggtacttctggcagaagaagaagcagcgctccggcgtcctgtgggacacccccagcccgcccgagatggagcgggccgtgctcgacgacggcatctaccgcatcctgcagcgggggctgctgggccgctcccaggtgggggtcggcgtgttccaggacggggtgttccacaccatgtggcacgtcacccggggcgccgtgctcatgtaccagggcaagcgcctggagcccagctgggcctccgtgaagaaggacctgatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctcgacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctgcccgagatcgaggacgaggtgttcaagaagcggaacctcaccatcatggacctgcacccgggcagcggcaagacccgccggtacctgcccgccatcgtgcgcgaggccatcaagcgcaagctccggaccctgatcctggcccccacgcgcgtcgtggcgtccgagatggccgaggccctcaaggggatgcccatccggtaccagaccaccgccgtcaagagcgagcacaccggccgcgagatcgtcgacctgatgtgccacgccacgttcaccatgcggctgctctccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctgagccggaagacgttcgacaccgagtaccagaagaccaagaacaacgactgggactacgtcgtgaccacggacatctccgagatgggcgccaacttccgcgccgaccgggtgatcgacccccgccggtgcctcaagcccgtcatcctgaaggacgggcccgagcgcgtgatcctggccggcccgatgcccgtcaccgtggcgagcgccgcccagcggcgcggccgcatcgggcggaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtcgagctgatgcgccggggcgacctccccgtgtggctgagctacaaggtggcctccgaggggttccagtacagcgaccgccggtggtgcttcgacggcgagcgcaacaaccaggtcctggaggagaacatggacgtggagatctggaccaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtcatgctgcacaactccgagcagggcgggaaggcctaccggcacgccatggaggagctccccgacaccatcgagacgctgatgctgctcgccctgatcgcggtgctgaccggcggggtgaccctcttcttcctgagcggcaagggcctggggaagacctccatcggcctcctgtgcgtcacggccagctccgccctgctctggatggccagcgtggagccccactggatcgccgcgtccatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagaccacgaagaaggacctggggatcggctacgtcgccgcggagaaccaccagcacgccaccatgctcgacgtggacctgcacccggccagcgcctggaccctgtacgccgtggcgaccacggtcatcacccccatgatgcgccacaccatcgagaacaccacggccaacatctccctcaccgccatcgccaaccaggccgcgatcctgatgggcctggacaaggggtggcccatcagcaagatggacatcggcgtgcccctcctggccctggggtgctactcccaggtgaacccgctcaccctgaccgccgccgtcctgatgctcgtggcgcactacgccatcatcggccccgggctgcaggccaaggccacgcgcgaggcccagaagcggaccgcggccggcatcatgaagaaccccaccgtggacggcatcgtcgccatcgacctggaccccgtggtgtacgacgccaagttcgagaagcagctcgggcagatcatgctgctgatcctctgcaccagccagatcctgctgatgcgcacgacctgggccctctgcgagtccatcaccctggcgaccggcccgctgacgaccctctgggaggggagccccggcaagttctggaacaccaccatcgccgtctccatggccaacatcttccggggcagctacctggccggggccggcctggcgttctccctcatgaagtccctcgggggcgggcgccgggggacgggcgcccagggggagaccctgggcgagaagtggaagcgccagctcaaccagctgtccaagagcgagttcaacacctacaagcggagcgggatcatggaggtggaccgctccgaggccaaggagggcctgaagcgcggggagaccacgaagcacgccgtgagccgcggcaccgcgaagctccggtggttcgtcgagcgcaacctggtgaagcccgagggcaaggtgatcgacctggggtgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcatgccgcccgagaagtgcgacacgctgctctgcgacatcggggagtccagcccgaaccccaccatcgaggagggccgcaccctgcgggtgctgaagatggtggagccctggctccgcggcaaccagttctgcatcaagatcctgaacccctacatgccgtccgtcgtggagaccctggagcagatgcagcggaagcacgggggcatgctcgtgcgcaaccccctgagccggaactccacgcacgagatgtactgggtcagctgcgggaccggcaacatcgtgtccgccgtgaacatgaccagccgcatgctgctcaaccgcttcaccatggcccaccggaagcccacgtacgagcgcgacgtcgacctgggcgcggggacccggcacgtggccgtggagcccgaggtcgccaacctggacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctcctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctgtgggggttcctctcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggcgaagggctcccgggccatctggtacatgtggctgggggcccgcttcctggagttcgaggccctcggcttcatgaacgaggaccactggttcagccgggagaactccctgagcggggtggagggcgaggggctgcacaagctcggctacatcctgcgcgacatctccaagatcccgggcgggaacatgtacgccgacgacaccgcgggctgggacacccgcatcaccgaggacgacctgcagaacgaggccaagatcacggacatcatggagcccgagcacgccctcctggccatgagcatcttcaagctgacctaccagaacaaggtcgtgcgggtgcagcgccccgccaagaacgggaccgtcatggacgtgatctcccggcgcgaccagcggggcagcggccaggtggggacctacggcctcaacacgttcaccaacatggaggtccagctgatccgccagatggagtccgaggggatcttcctgcccagcgagctcgagaccccgaacctggcggagcgggccctggactggctcgagaagcacggcgccgagcgcctgaagcggatggccatctccggggacgactgcgtggtgaagcccatcgacgaccgcttcgccaccgcgctgacggccctcaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctggtgggccgcgcccgggtgagccagggggccggctggtccctccgcgagaccgcctgcctgggcaagagctacgcgcagatgtggcagctgatgtacttccaccggcgcgacctccggctggccgccaacgccatctgctccgcggtccccgtggactgggtgcccgccagccgcaccacctggagcatccacgcccaccaccagtggatgaccacggaggacatgctgtccgtctggaaccgcgtgtggatcgaggagaacccgtggatggaggacaagacccacgtgagctcctgggaggaggtcccctacctcggcaagcgggaggaccagtggtgcggcagcctgatcgggctgaccgcccgcgccacctgggcgacgaacatccaggtggccatctcccaggtgcggcgcctcatcggcaacgagaactacctggactacatgaccagcatgaagcggttcaagaacgagtccgaccccgagggggccctgtggtga
